United States Patent
Schroeder et al.

(10) Patent No.: US 10,689,660 B2
(45) Date of Patent: Jun. 23, 2020

(54) COMPOSITIONS AND METHODS FOR MEDIATING PLANT STOMATAL DEVELOPMENT IN RESPONSE TO CARBON DIOXIDE AND APPLICATIONS FOR ENGINEERING DROUGHT TOLERANCE IN PLANTS

(71) Applicant: THE REGENTS OF THE UNIVERSITY OF CALIFORNIA, Oakland, CA (US)

(72) Inventors: Julian I. Schroeder, La Jolla, CA (US); Cawas Engineer, San Diego, CA (US)

(73) Assignee: THE REGENTS OF THE UNIVERSITY OF CALIFORNIA, Oakland, CA (US)

( * ) Notice: Subject to any disclaimer, the term of this patent is extended or adjusted under 35 U.S.C. 154(b) by 1118 days.

(21) Appl. No.: 14/408,234

(22) PCT Filed: Jun. 21, 2013

(86) PCT No.: PCT/US2013/047102
§ 371 (c)(1),
(2) Date: Dec. 15, 2014

(87) PCT Pub. No.: WO2013/192545
PCT Pub. Date: Dec. 27, 2013

(65) Prior Publication Data
US 2015/0315606 A1 Nov. 5, 2015

Related U.S. Application Data

(60) Provisional application No. 61/663,071, filed on Jun. 22, 2012.

(51) Int. Cl.
C12N 15/82 (2006.01)

(52) U.S. Cl.
CPC ..... *C12N 15/8269* (2013.01); *C12N 15/8218* (2013.01); *C12N 15/8261* (2013.01); *C12N 15/8271* (2013.01); *C12N 15/8273* (2013.01)

(58) Field of Classification Search
None
See application file for complete search history.

(56) References Cited

U.S. PATENT DOCUMENTS 6,653,535 B1 11/2003 Tarczynski et al.
2004/0106198 A1 6/2004 Hanley et al.
2004/0216190 A1 10/2004 Kovalic
2008/0318790 A1 12/2008 Ebneth et al.
2010/0299782 A1 11/2010 Schroeder et al.

FOREIGN PATENT DOCUMENTS

WO 2000022144 A2 4/2000
WO 2011071050 A1 6/2011

OTHER PUBLICATIONS

Genbank Accession NP_564107, submitted Feb. 18, 2011.*
Barrett et al. (Proteinases: Peptide Peptide and Protein Group Colloquium Organized and Edited by A. J. Rivett (University of Leicester) 638th Meeting held at Reading University, Apr. 10-12, 1991, p. 707-715). (Year: 1991).*
Rautengarten et al. PLoS Computational Biology 1.4 (2005): e40. (Year: 2005).*
Berger et al. Genes Dev., 14 (2000), pp. 1119-1131. (Year: 2000).*
Yoo et al. The Plant Cell (2010): 4128-4141. (Year: 2010).*
UniProt Accession Q2L3T0, integrated on Mar. 7, 2006. (Year: 2006).*
Sugano et al. Nature 463.7278 (2010): 241-244 (Year: 2010).*
Mustilli, Anna-Chiara et al., "Arabidopsis OST1 Protein Kinase Mediates the Regulation of Stomatal Aperture by Abscisic Acid and Acts Upstream of Reactive Oxygen Species Production," The Plant Cell, vol. 14, Dec. 2002, pp. 3089-3099.
Moon, Kihwan, International Preliminary Report on Patentability, PCT/US2013/047102, The International Bureau of WIPO, dated Dec. 31, 2014.
O. Shanova, International Search Report and Written Opinion, PCT/US2013/047102, dated Oct. 24, 2013.
Von Groll, Uritza et al., "The Subtilisin-Like Serine Protease SDD1 Mediates Cell-to-Cell Signaling during *Arabidopsis* Stomatal Development", The Plant Cell, vol. 14, Jul. 2002, pp. 1527-139.
Database UniProt: AEE29946.1, Jun. 28, 2011.
Database UniProt:CAJ75644.1, Mar. 7, 2006.
Database UniProt:AAK59433.1, Dec. 1, 2001.
Database UniProt: AEE86300.1, Jul. 22, 2008.
Official Action issued in UA a 2015 00460 dated May 4, 2018.

* cited by examiner

*Primary Examiner* — Charles Logsdon
(74) *Attorney, Agent, or Firm* — Greer, Burns & Crain, Ltd.; Gregory P. Einhorn

(57) ABSTRACT

In alternative embodiments, the invention provides compositions and methods for manipulating the exchange of water and/or carbon dioxide ($CO_2$) through plant stomata by controlling the expression of a novel apoplastic subtilisin-like serine endopeptidase-like protein. In alternative embodiments, the invention provides plants having increased water use efficiency, and drought-resistant plants; and methods for engineering of water transpiration and water use efficiency in plants, and engineering plants with increased water use efficiency and drought-resistant plants.

4 Claims, 54 Drawing Sheets

Specification includes a Sequence Listing.

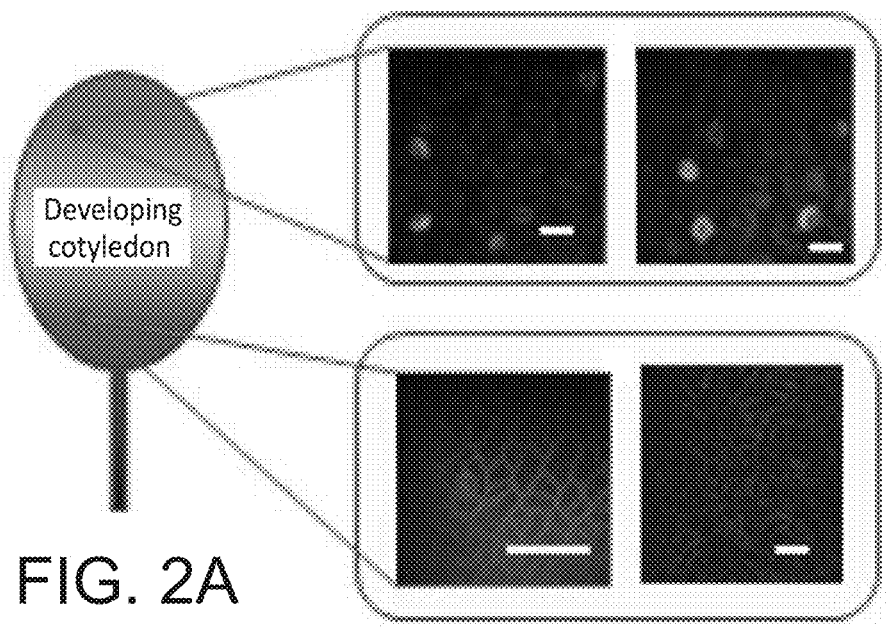
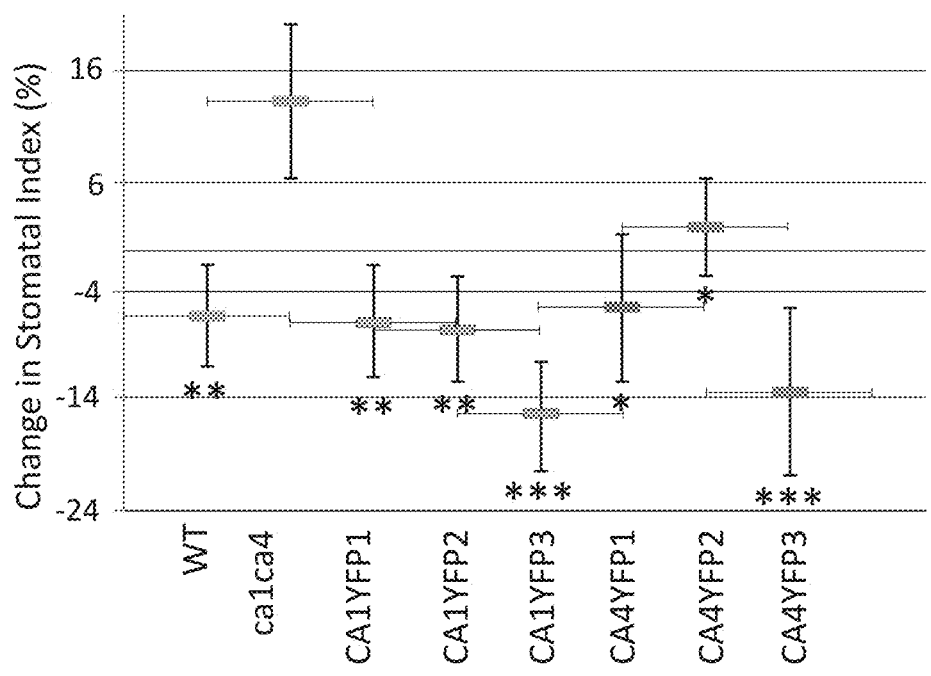
FIG. 2A
FIG. 2B
FIG. 2C
FIG. 2D

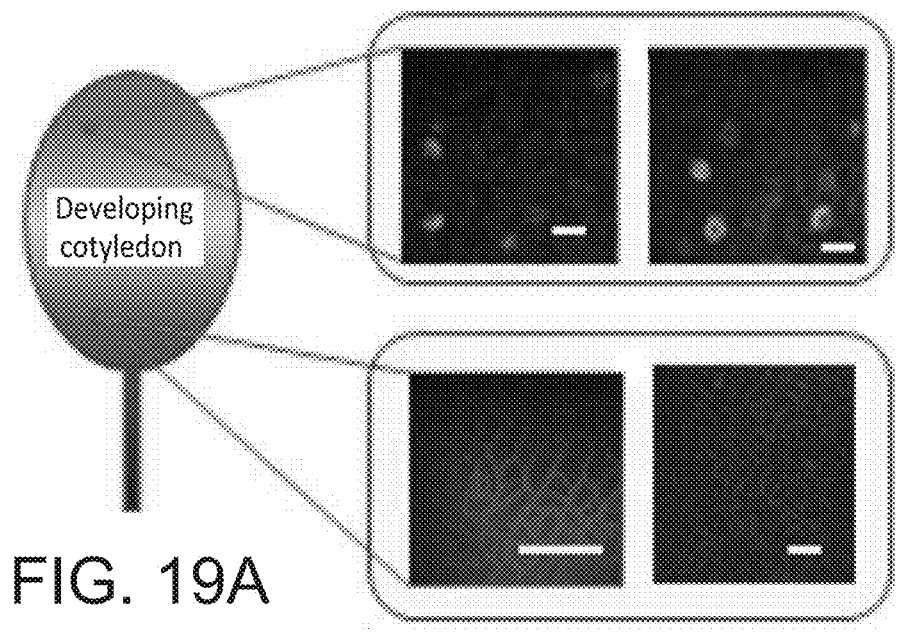
FIG. 19A
FIG. 19B
FIG. 19C
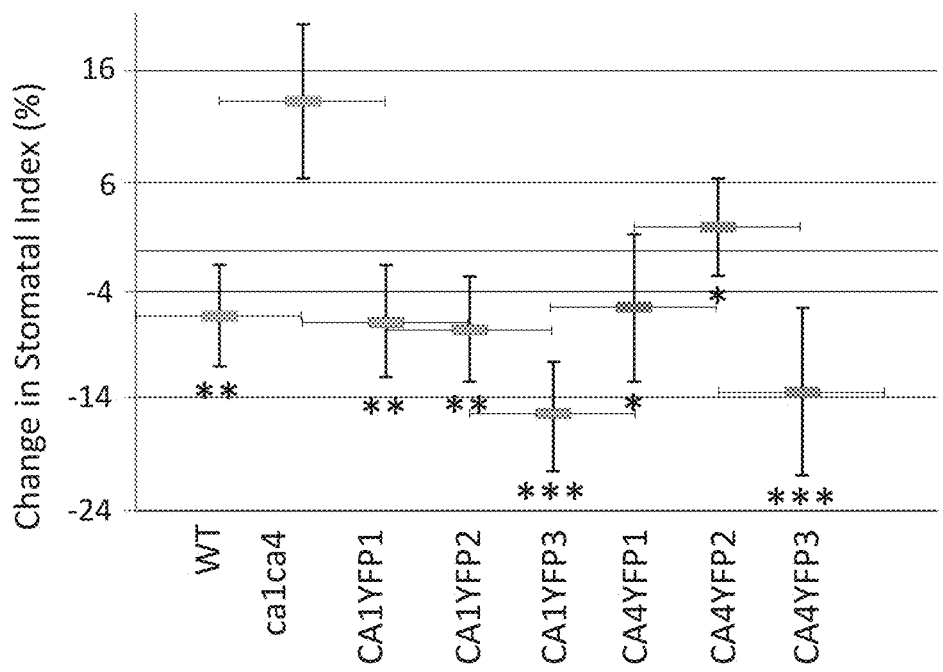
FIG. 19D

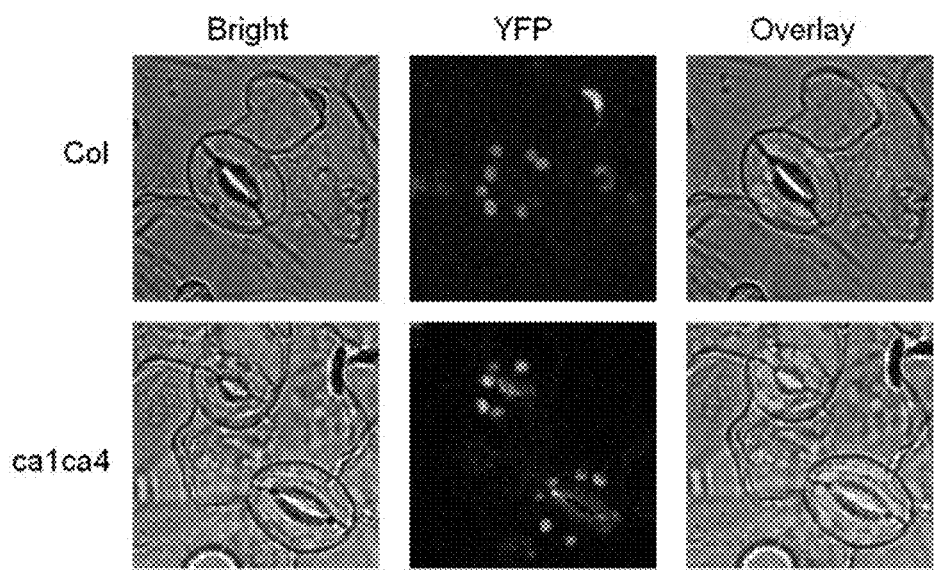
FIG. 31A
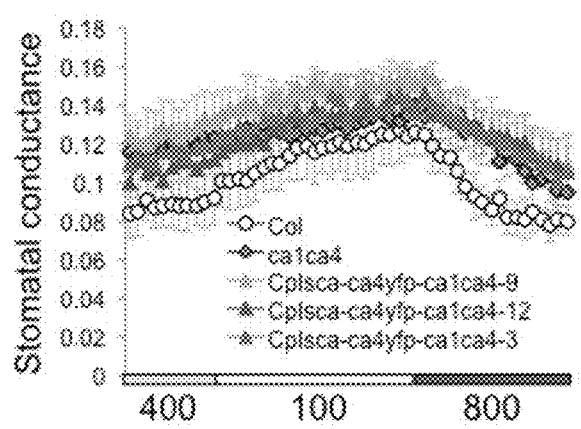 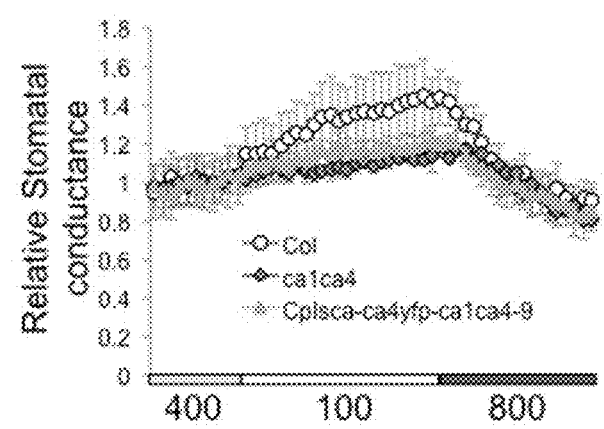
FIG. 31B
FIG. 31C

COMPOSITIONS AND METHODS FOR MEDIATING PLANT STOMATAL DEVELOPMENT IN RESPONSE TO CARBON DIOXIDE AND APPLICATIONS FOR ENGINEERING DROUGHT TOLERANCE IN PLANTS

CROSS-REFERENCE TO RELATED APPLICATIONS

This United States utility patent application is the § 371 national phase of PCT international patent application no. PCT/US2013/047102, having an international filing date of Jun. 21, 2013, which claims benefit of priority to U.S. Provisional Patent Application Ser. No. 61/663,071, filed Jun. 22, 2012. The aforementioned applications are expressly incorporated herein by reference in their entirety and for all purposes.

STATEMENT AS TO FEDERALLY SPONSORED RESEARCH

This invention was made with government support under grant no. MCB0918220 awarded by the National Science Foundation, and grant no. GM060396, awarded by the National Institutes of Health (NIH). The government has certain rights in this invention.

INCORPORATION OF SEQUENCE LISTING

The sequence listing that is contained in the file named SEQ ID 371-US2013-047102 SCHROEDER ST25 ST25.txt, which is 628 kilobytes (KB) (644,056 bytes) (measured in MS windows operating system; 632 KB (647, 168 bytes) on disk), and was created on 15 Dec. 2014, is filed herewith and incorporated herein by reference.

TECHNICAL FIELD

This invention generally relates to plant molecular and cellular biology. In alternative embodiments, the invention provides compositions and methods for manipulating the exchange of water and/or carbon dioxide ($CO_2$) through plant stomata comprising the step of modulating the stomatal density of plants through alteration of the expression of a novel apoplastic subtilisin-like serine endopeptidase-like protein, optionally combined with the control of stomatal movement through alteration of the expression of $CO_2$ sensor genes and/or the with the expression of OST1 (Open Stomata 1) protein kinase and the related protein kinases SnRK2.2 and SnRK2.3, and their genes. In alternative embodiments, the invention provides plants, plant tissues and cells, having increased water use efficiency, and drought-resistant plants, plant tissues and cells; and methods for engineering of water transpiration and water use efficiency in plants, and engineering plants with increased water use efficiency and drought-resistant plants, plant tissues and cells.

BACKGROUND

Stomatal pores in the epidermis of plant leaves enable the control of plant water loss and the influx of $CO_2$ into plants from the atmosphere. Carbon dioxide is taken up for photosynthetic carbon fixation and water is lost through the process of transpiration through the stomatal pores. Each stomate is made up of a specialized pair of cells named guard cells, which can modify the size of the stomatal pore by controlling guard cell turgor status.

An important trait in agriculture, in biotechnological applications and the production of biofuels is the water use efficiency of plants. The water use efficiency defines how well a plant can balance the loss of water through stomata with the net $CO_2$ uptake into leaves for photosynthesis and hence its biomass accumulation. Several biotic and abiotic factors influence the state of stomatal opening as well as stomatal cell density, thereby optimizing the water use efficiency of a plant in a given condition. The concentration of $CO_2$ regulates stomatal density, where high levels of $CO_2$ will lead to a decrease in stomatal density.

WO 2008/134571, Schroeder et al., describes compositions and methods for manipulating the exchange of water and/or carbon dioxide trough plant stomata by controlling carbon dioxide sensor genes. The document provides compositions and methods for opening or closing a stomatal pore on a guard cell in the epidermis of a plant.

SUMMARY

In alternative embodiments, the invention provides methods for:
increasing the water use efficiency of a guard cell, a root cell, a stomatal lineage stage-specific cell, a plant leaf, a plant organ, a plant part or a plant;
increasing the rate of growth or biomass production in a guard cell, a root cell, a stomatal lineage stage-specific cell, a plant leaf, a plant organ, a plant part or a plant;
enhancing the carbon dioxide ($CO_2$) sensitivity of a guard cell, a root cell, a stomatal lineage stage-specific cell, a plant leaf, a plant organ, plant part or a plant;
down-regulating or decreasing carbon dioxide ($CO_2$) and/or water exchange in a guard cell, a root cell, a stomatal lineage stage-specific cell, a plant leaf, a plant organ, a plant part or a plant;
decreasing the uptake of carbon dioxide ($CO_2$) of a guard cell, a root cell, a stomatal lineage stage-specific cell, a plant leaf, a plant organ, plant part or a plant; or
increasing the drought tolerance of a guard cell, a root cell, a stomatal lineage stage-specific cell, a plant leaf, a plant organ, a plant part or a plant; or
decreasing the heat resistance or tolerance (e.g., under conditions of drought or increased atmospheric carbon dioxide) of a guard cell, a root cell, a stomatal lineage stage-specific cell, a plant leaf, a plant organ, a plant part or a plant;
comprising:
(a) in the guard cell, root cell, stomatal lineage stage-specific cell, plant leaf, plant organ, plant part or plant, increasing the expression and/or activity of:
(1) a serine endopeptidase, an apoplastic subtilisin-like serine endopeptidase like protein, an ATSBT5.2-like protein, or a subtilisin-like serine endopeptidase family protein, which is capable of cleaving or cleaves an EPF2 protein (Epidermal patterning factor 2) in a manner such that it facilitates EPF2 binding to an ERECTA receptor,
(2) a serine endopeptidase, an apoplastic subtilisin-like serine endopeptidase like protein, an ATSBT5.2-like protein, or a subtilisin-like serine endopeptidase family protein, gene, cDNA or mRNA (message) encoding a polypeptide with a serine endopeptidase, an apoplastic subtilisin-like serine endopeptidase like protein, an ATSBT5.2-like protein, or a subtilisin-like serine endopeptidase family protein activity, or
(3) a combination of (1) and (2);
(b) the method of (a), wherein the increasing of expression and/or activity of the serine endopeptidase, apoplastic subtilisin-like serine endopeptidase like protein, ATSBT5.2-like protein, or subtilisin-like serine endopeptidase family protein, is by:
(1) providing a heterologous serine endopeptidase, apoplastic subtilisin-like serine endopeptidase like protein, ATSBT5.2-like protein, subtilisin-like serine endopeptidase family protein or endopeptidase expressing nucleic acid (e.g., a gene, cDNA or message) and expressing the gene, cDNA, message and/or protein in the guard cell, root cell, stomatal lineage stage-specific cell, plant leaf, plant organ, plant part or plant;
(2) increasing of expression and/or activity of a homologous serine endopeptidase-expressing, ATSBT5.2-expressing, subtilisin-like serine endopeptidase family protein-expressing, or endopeptidase-expressing nucleic acid (e.g., a gene, cDNA or message); or,
(3) a combination of (1) and (2);
thereby:
increasing the water use efficiency of the guard cell, root cell, stomatal lineage stage-specific cell, plant leaf, plant organ, plant part or plant;
increasing the rate of growth or biomass production in the guard cell, root cell, stomatal lineage stage-specific cell, plant leaf, plant organ, plant part or plant;
enhancing the carbon dioxide ($CO_2$) sensitivity of the guard cell, root cell, stomatal lineage stage-specific cell, plant leaf, plant organ, plant part or plant;
down-regulating or decreasing carbon dioxide ($CO_2$) and/or water exchange in the guard cell, root cell, stomatal lineage stage-specific cell, plant leaf, plant organ, plant part or plant;
decreasing the uptake of carbon dioxide ($CO_2$) in the guard cell, root cell, stomatal lineage stage-specific cell, plant leaf, plant organ, plant part or plant;
increasing the drought tolerance of the guard cell, root cell, stomatal lineage stage-specific cell, plant leaf, plant organ, plant part or plant; or
decreasing the heat resistance or tolerance of the guard cell, root cell, stomatal lineage stage-specific cell, plant leaf, plant organ, plant part or plant.
In alternative embodiments, the invention provides methods for:
up-regulating or increasing carbon dioxide ($CO_2$) and/or water exchange in a guard cell, a root cell, a stomatal lineage stage-specific cell, a plant leaf, a plant organ, a plant part or a plant;
decreasing the water use efficiency of a guard cell, a root cell, a stomatal lineage stage-specific cell, a plant leaf, a plant organ, a plant part or a plant;
decreasing (desensitizing) the carbon dioxide ($CO_2$) sensitivity of a guard cell, a root cell, a stomatal lineage stage-specific cell, a plant leaf, a plant organ, a plant part or a plant;
upregulating or increasing carbon dioxide ($CO_2$) and/or water exchange in a guard cell, a root cell, a stomatal lineage stage-specific cell, a plant leaf, a plant organ, a plant part or a plant;
increasing the uptake of $CO_2$ in a guard cell, a root cell, a stomatal lineage stage-specific cell, a plant leaf, a plant organ, a plant part or a plant;
decreasing drought tolerance in a guard cell, a root cell, a stomatal lineage stage-specific cell, a plant leaf, a plant organ, a plant part or a plant; or
increasing the heat resistance or tolerance (e.g., under conditions of drought or increased atmospheric carbon dioxide);
comprising:
(a) in a cell of the guard cell, root cell, stomatal lineage stage-specific cell, plant leaf, plant organ, plant part or plant, decreasing the expression and/or activity of:
(1) a nucleic acid expressing a serine endopeptidase, an apoplastic subtilisin-like serine endopeptidase like protein, an ATSBT5.2-like protein, or a subtilisin-like serine endopeptidase family protein, which is capable of cleaving or cleaves EPF2 protein (Epidermal patterning factor 2) in a manner such that it facilitates EPF2 binding to an ERECTA receptor; or
(2) a serine endopeptidase, an apoplastic subtilisin-like serine endopeptidase like protein, an ATSBT5.2-like protein, an apoplastic subtilisin-like serine endopeptidase or an endopeptidase, or
a subtilisin-like serine endopeptidase family protein, gene, cDNA or mRNA (message) encoding a polypeptide with a serine endopeptidase, an ATSBT5.2-like protein, an apoplastic subtilisin-like serine endopeptidase or an endopeptidase activity;
(b) the method of (a), wherein the decreasing of expression and/or activity of the serine endopeptidase, apoplastic subtilisin-like serine endopeptidase-like protein, ATSBT5.2-like protein or endopeptidase, is by:
(1) providing a heterologous antisense, iRNA, miRNA or artificial microRNA (miRNA) inhibitory to: a serine endopeptidase-encoding, an ATSBT5.2-like protein-encoding, an apoplastic subtilisin-like serine endopeptidase-like protein-encoding, subtilisin-like serine endopeptidase family protein-encoding or endopeptidase-encoding nucleic acid (e.g., to decrease or abrogate the expression or activity of a gene, cDNA or mRNA (message)), or any nucleic acid or compound inhibitory to the expression of the serine endopeptidase, ATSBT5.2-like protein, apoplastic subtilisin-like serine endopeptidase-like protein, subtilisin-like serine endopeptidase family protein or endopeptidase; and, expressing the inhibitory nucleic acid or compound, or the heterologous antisense, iRNA, miRNA or artificial microRNA (miRNA), in the guard cell, root cell, stomatal lineage stage-specific cell, plant leaf, plant organ, plant part or plant;
(2) decreasing of expression and/or activity of a homologous serine endopeptidase-encoding, ATSBT5.2-like protein-encoding, apoplastic subtilisin-like serine endopeptidase-like protein-encoding, subtilisin-like serine endopeptidase family protein-encoding or endopeptidase-encoding nucleic acid (e.g., a gene, cDNA or mRNA (message)); or,
(3) a combination of (1) and (2);
thereby:
up-regulating or increasing carbon dioxide ($CO_2$) and/or water exchange in the guard cell, root cell, stomatal lineage stage-specific cell, plant leaf, plant organ, plant part or plant;
decreasing the water use efficiency of the guard cell, root cell, stomatal lineage stage-specific cell, plant leaf, plant organ, plant part or plant;
increasing the rate of growth or biomass production in the guard cell, root cell, stomatal lineage stage-specific cell, plant leaf, plant organ, plant part or plant;

decreasing (desensitizing) the carbon dioxide ($CO_2$) sensitivity of the guard cell, root cell, stomatal lineage stage-specific cell, plant leaf, plant organ, plant part or plant;

up-regulating or increasing carbon dioxide ($CO_2$) and/or water exchange in the guard cell of the guard cell, root cell, stomatal lineage stage-specific cell, plant leaf, plant organ, plant part or plant;

increasing the uptake of $CO_2$ in the guard cell, root cell, stomatal lineage stage-specific cell, plant leaf, plant organ, plant part or plant;

decreasing the drought tolerance of the guard cell, root cell, stomatal lineage stage-specific cell, plant leaf, plant organ, plant part or plant; or increasing the heat resistance or tolerance of the guard cell, root cell, stomatal lineage stage-specific cell, plant leaf, plant organ, plant part or plant.

In alternative embodiments, the serine endopeptidase, ATSBT5.2-like protein or subtilisin-like serine endopeptidase family protein, comprises an amino acid sequence having between about 75% to 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with (a) an amino acid sequence comprising or consisting any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72;

(b) an amino acid sequence comprising or consisting any one of the amino acid sequences of SEQ ID NO:2 or SEQ ID NO:4;

(c) an amino acid sequence comprising or consisting any one of the amino acid sequences of SEQ ID NO:5, SEQ ID NO:8, SEQ ID NO:17, SEQ ID NO:22, SEQ ID NO:40 or SEQ ID NO:53; or (d) a processed form (e.g., a "mature" form, e.g., a form lacking a signal sequence) of a protein of (a), (b) or (c).

In alternative embodiments, the serine endopeptidase, ATSBT5.2-like protein or subtilisin-like serine endopeptidase family protein, is encoded by a nucleotide sequence comprising or consisting of:

(a) any of the nucleotide sequences of SEQ ID NO:1; or (b) any of the nucleotide sequences encoding any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72;

(c) any of the nucleotide sequences encoding an amino acid sequence comprising or consisting any one of the amino acid sequences of SEQ ID NO:5, SEQ ID NO:8, SEQ ID NO:17, SEQ ID NO:22, SEQ ID NO:40 or SEQ ID NO:53; or (d) a processed form (e.g., a "mature" form, e.g., a form lacking a signal sequence) of a protein of (a), (b) or (c).

In alternative embodiments, the plant is characterized by controlled $CO_2$ exchange under ambient 395 ppm $CO_2$, or under ambient between 365 and 395 ppm $CO_2$, elevated ppm $CO_2$ or reduced ppm $CO_2$ or the plant is characterized by controlled water exchange under ambient 395 ppm $CO_2$, or under ambient between 365 and 395 ppm $CO_2$, elevated ppm $CO_2$ or reduced ppm $CO_2$, wherein optionally reduced $CO_2$ is in the range of about 390 ppm CO2 to about 1 ppm $CO_2$, or below about 400 ppm, and optionally elevated $CO_2$ is between about 390 ppm to about 1200 ppm $CO_2$, or above about 350, 360, 370, 380 or 390 ppm to about 1100, 1200, 1300, 1400 or 1500 ppm.

In alternative embodiments, the serine endopeptidase-expressing, ATSBT5.2-like protein-expressing, subtilisin-like serine endopeptidase family protein-expressing or endopeptidase-expressing nucleic acid (e.g., gene, cDNA or mRNA), is operably linked to a plant expressible promoter, an inducible promoter, a constitutive promoter, a root specific promoter, a stomatal lineage stage-specific cell specific promoter, a guard cell specific promoter, a drought-inducible promoter, a stress-inducible promoter or a guard cell active promoter.

In alternative embodiments, the:

up-regulating or increasing carbon dioxide ($CO_2$) and/or water exchange in the guard cell, root cell, stomatal lineage stage-specific cell, plant leaf, plant organ, plant part or plant;

decreasing of the water use efficiency of the guard cell, root cell, stomatal lineage stage-specific cell, plant leaf, plant organ, plant part or plant; or decreasing or desensitizing of the carbon dioxide ($CO_2$) sensitivity of the guard cell, root cell, stomatal lineage stage-specific cell, plant leaf, plant organ, plant part or plant; or upregulating or increasing of the carbon dioxide ($CO_2$) and/or water exchange in the guard cell, root cell, stomatal lineage stage-specific cell, plant leaf, plant organ, plant part or plant;

comprises:

(a) providing:

(i) a nucleic acid inhibitory to the expression of a serine endopeptidase-expressing, ATSBT5.2-like protein-expressing, subtilisin-like serine endopeptidase family protein-expressing or endopeptidase-expressing nucleic acid; and/or (ii) a nucleic acid inhibitory (e.g., an antisense, an iRNA, an siRNA, a micro RNA or miRNA or an artificial micro RNA) to the expression of a serine endopeptidase, an ATSBT5.2-like protein, a subtilisin-like serine endopeptidase family protein, or an endopeptidase gene, cDNA or mRNA;

(b) expressing the nucleic acid inhibitory to the expression of the serine endopeptidase-expressing, the ATSBT5.2-like protein-expressing, the subtilisin-like serine endopeptidase family protein-expressing or the endopeptidase-expressing nucleic acid, gene, cDNA or mRNA (e.g., expressing an antisense, iRNA or inhibitory nucleic acid) in a guard cell; and/or, expressing a nucleic acid inhibitory to the expression of the serine endopeptidase-expressing, the ATSBT5.2-like protein-expressing, the subtilisin-like serine endopeptidase family protein-expressing or the endopeptidase-expressing nucleic acid, gene, cDNA or mRNA or transcript, thereby up-regulating or increasing carbon dioxide ($CO_2$) and/or water exchange in a guard cell; decreasing the water use efficiency of a guard cell, a plant, plant leaf, plant organ or plant part; or decreasing (desensitizing) the carbon dioxide ($CO_2$) sensitivity of a plant, plant leaf, plant organ or plant part; or upregulating or increasing carbon dioxide ($CO_2$) and/or water exchange in a guard cell of a plant, plant leaf, plant organ or plant part.

In alternative embodiments, the nucleic acid inhibitory to the expression of a CO2 sensor protein-expressing nucleic acid comprises:

(a) a nucleotide sequence of at least about 11, 12, 13, 14, 15, 16, 17, 18, or 19 or more nucleotides having at least about 90%, 91%, 92%, 93%, 94%, 95%, 96%, 97%, 98% or 99% or more sequence identity with a nucleotide sequence encoding a serine endopeptidase, a ATSBT5.2-like polypeptide, a subtilisin-like serine endopeptidase family protein, or an endopeptidase, and optionally comprising an amino acid sequence having between about 75% and 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with (a) an amino acid sequence comprising or consisting any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72; or (b) an amino acid sequence comprising or consisting any one of the amino acid sequences of SEQ ID NO:2 or SEQ ID NO:4; or (c) an amino acid sequence comprising or consisting any one of the amino acid sequences of SEQ ID NO:5, SEQ ID NO:8, SEQ ID NO:17, SEQ ID NO:22, SEQ ID NO:40 or SEQ ID NO:53; or (b) a partial or complete complementary sequence of the nucleotide sequence (a).

In alternative embodiments, the nucleic acid inhibitory to the expression of a serine endopeptidase-expressing, a ATSBT5.2-like polypeptide-expressing, a subtilisin-like serine endopeptidase family protein-expressing, or an endopeptidase-expressing nucleic acid comprises:

(a) a nucleotide sequence of at least about 11, 12, 13, 14, 15, 16, 17, 18, or 19 or more nucleotides having at least about 90%, 91%, 92%, 93%, 94%, 95%, 96%, 97%, 98% or 99% or more sequence identity with a nucleotide sequence of SEQ ID NO:1, or a nucleotide sequence encoding SEQ ID NO:4, SEQ ID NO:5, SEQ ID NO:7, SEQ ID NO:9, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43 or SEQ ID NO:45; or (b) a partial or complete complementary sequence of the nucleotide sequence (a).

In alternative embodiments, the nucleic acid inhibitory to the expression of a serine endopeptidase-expressing, a ATSBT5.2-like polypeptide-expressing, a subtilisin-like serine endopeptidase family protein-expressing, or an endopeptidase-expressing, nucleic acid comprises the nucleotide sequence of at least about 11, 12, 13, 14, 15, 16, 17, 18, or 19 or more nucleotides and a complementary sequence to the nucleotide sequence of at least about 11, 12, 13, 14, 15, 16, 17, 18, or 19 or more nucleotides.

In alternative embodiments, the nucleotide sequence comprising the at least about 11, 12, 13, 14, 15, 16, 17, 18, or 19 or more nucleotides is a nucleotide sequence comprising at least 50 or 100 or 300 nucleotides having between 75 to 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, to the nucleotide sequence encoding a polypeptide having the serine endopeptidase, ATSBT5.2-like protein, subtilisin-like serine endopeptidase family protein or endopeptidase protein activity.

In alternative embodiments, the plant is characterized by controlled $CO_2$ exchange under ambient 395 ppm $CO_2$, or under ambient between 365 and 395 ppm $CO_2$, elevated ppm $CO_2$ or reduced ppm $CO_2$, or the plant is characterized by controlled water exchange under ambient 395 ppm $CO_2$, or under ambient between 365 and 395 ppm $CO_2$, elevated ppm $CO_2$ or reduced ppm $CO_2$.

In alternative embodiments, the serine endopeptidase, ATSBT5.2-like protein, subtilisin-like serine endopeptidase family protein or endopeptidase-inhibitory nucleic acid is operably linked to a plant expressible promoter, an inducible promoter, a constitutive promoter, a root specific promoter, a stomatal lineage stage-specific cell specific promoter, a guard cell specific promoter, a drought-inducible promoter, a stress-inducible promoter or a guard cell active promoter.

In alternative embodiments, the invention provides methods for regulating water exchange in a cell of a plant, plant cell, plant leaf, plant organ or plant part comprising:

(a) expressing or increasing the expression of a serine endopeptidase, ATSBT5.2-like protein, subtilisin-like serine endopeptidase family protein or endopeptidase, protein-encoding gene, cDNA or mRNA or transcript, comprising: providing a serine endopeptidase, ATSBT5.2-like protein, subtilisin-like serine endopeptidase family protein or endopeptidase protein expressing nucleic acid, gene, cDNA or mRNA or transcript, in the plant, guard cell, plant cell, plant leaf, plant organ or plant part; or (b) decreasing the expression of a serine endopeptidase, ATSBT5.2-like protein, subtilisin-like serine endopeptidase family protein or endopeptidase protein encoding gene, cDNA or mRNA or transcript in the plant, guard cell, plant cell, plant leaf, plant organ or plant part, by expressing a nucleic acid inhibitory to the expression of the serine endopeptidase, ATSBT5.2-like protein, subtilisin-like serine endopeptidase family protein or endopeptidase protein-expressing nucleic acid, gene, cDNA or mRNA or transcript in the plant, guard cell, plant cell, plant leaf, plant organ, or plant part;

thereby regulating water exchange, wherein down-regulating or decreasing water exchange is achieved by expression or increased expression of serine endopeptidase, ATSBT5.2-like protein, subtilisin-like serine endopeptidase family protein or endopeptidase protein and wherein up-regulating or increasing water exchange is achieved by reduction of expression of the ATSBT5.2-like protein in the plant, guard cell, plant cell, plant leaf, plant organ or plant part.

In alternative embodiments, the increasing or decreasing of the expression is in the plant guard cell or in a precursor cell of the plant guard cell.

In alternative embodiments, the invention provides methods for regulating water uptake or water loss in a plant, plant cell, plant leaf, plant organ or plant part comprising:

(a) expressing or increasing the expression of a serine endopeptidase, ATSBT5.2-like protein, subtilisin-like serine endopeptidase family protein or endopeptidase protein-encoding gene, cDNA or mRNA or transcript, by providing a serine endopeptidase, ATSBT5.2-like protein, subtilisin-like serine endopeptidase family protein or endopeptidase protein expressing nucleic acid, gene, cDNA or mRNA or transcript in the plant, guard cell, plant cell, plant leaf, plant organ or plant part; or (b) decreasing the expression of a serine endopeptidase, ATSBT5.2-like protein, subtilisin-like serine endopeptidase family protein or endopeptidase protein encoding gene, cDNA or mRNA or transcript in the plant, guard cell, plant cell, plant leaf, plant organ or plant part, by expressing a nucleic acid inhibitory to the expression of the ATSBT5.2-like protein expressing nucleic acid, gene, cDNA or mRNA or transcript in the plant, guard cell, plant cell, plant leaf, plant organ, or plant part;

thereby regulating water uptake or water loss, wherein down-regulating water uptake or causing water conservation is achieved by expression or increased expression of the ATSBT5.2-like protein and wherein up-regulating water exchange or increasing water loss is achieved by reduction of expression of the serine endopeptidase, ATSBT5.2-like protein, subtilisin-like serine endopeptidase family protein or endopeptidase protein in the plant, plant cell, plant leaf, plant organ or plant part.

In alternative embodiments, the increasing or decreasing of the expression occurs in the plant guard cell or in a precursor cell of the plant guard cell.

In alternative embodiments, the invention provide methods for making a plant with enhanced water use efficiency (WUE), or drought-resistant plant, plant cell, plant leaf, plant organ or plant part, comprising:

expressing or increasing the expression of a serine endopeptidase, ATSBT5.2-like protein, subtilisin-like serine endopeptidase family protein or endopeptidase protein encoding gene, cDNA or mRNA or transcript in the plant, guard cell, plant cell, plant leaf, plant organ or plant part thereby regulating water uptake or water loss and increasing the WUE in the plant, plant cell, plant leaf, plant organ or plant part.

In alternative embodiments, the increasing of the expression occurs in the plant guard cell or in a precursor cell of the plant guard cell.

In alternative embodiments, the invention provides methods for making a heat-resistant plant, guard cell, plant cell, plant leaf, plant organ, or plant part, comprising:

decreasing the expression of a serine endopeptidase, ATSBT5.2-like protein, subtilisin-like serine endopeptidase family protein or endopeptidase protein encoding gene or transcript in the plant, guard cell, plant cell, plant leaf, plant organ or plant part, by expressing a nucleic acid inhibitory to the expression of the serine endopeptidase, ATSBT5.2-like protein, subtilisin-like serine endopeptidase family protein or endopeptidase protein-expressing nucleic acid, gene, cDNA or mRNA or transcript in the plant, guard cell, plant cell, plant leaf, plant organ, or plant part, thereby making a heat-resistant plant, guard cell, plant cell, plant leaf, plant organ, or plant part.

In alternative embodiments, the decreasing of the expression occurs in the plant guard cell or in a precursor of the plant guard cell.

In alternative embodiments, the invention provides methods for increasing the number of stomatal pores compared to the total number of cells (increasing the stomatal density, stomatal index and/or stomatal size) in a plant, plant part, a plant organ, a plant leaf, comprising:

decreasing the expression of a serine endopeptidase, ATSBT5.2-like protein, subtilisin-like serine endopeptidase family protein or endopeptidase protein-encoding gene, cDNA or mRNA or transcript in the plant, guard cell, plant cell, plant leaf, plant organ or plant part, by expressing a nucleic acid inhibitory to the expression of the serine endopeptidase, ATSBT5.2-like protein, subtilisin-like serine endopeptidase family protein or endopeptidase protein-expressing nucleic acid, gene, cDNA or mRNA or transcript in the plant, guard cell, plant cell, plant leaf, plant organ, or plant part, thereby increasing the stomatal density, stomatal index and/or stomatal size in the epidermis of the plant, plant part, plant organ or plant leaf.

In alternative embodiments, the decreasing of the expression occurs in the plant guard cell or in a precursor cell thereof.

In alternative embodiments, the invention provides methods for decreasing the number of stomatal pores compared to the total number of cells (decreasing the stomatal density, stomatal index and/or stomatal size) in a plant, plant part, a plant organ, a plant leaf, comprising:

expressing or increasing the expression of a serine endopeptidase, ATSBT5.2-like protein, subtilisin-like serine endopeptidase family protein or endopeptidase protein-encoding gene, cDNA or mRNA or transcript in the plant, guard cell, plant cell, plant leaf, plant organ or plant part thereby decreasing the stomatal density, stomatal index and/or stomatal size in the epidermis of the plant, plant part, plant leaf, plant organ.

In alternative embodiments, the expression or increase in expression occurs in the plant guard cell.

In alternative embodiments, the invention provides methods method for enhancing or optimizing biomass accumulation in a plant, a plant leaf, a plant organ, a plant part, a plant cell or seed by balancing the loss of water through stomata with the net CO$_2$ uptake for photosynthesis, and hence enhancing or optimizing biomass accumulation in the plant, plant leaf, plant part, plant organ, plant cell or seed, comprising increasing or decreasing the number of stomatal pores in the epidermis of a plant, plant leaf, plant organ or plant part using a method of the invention.

In alternative embodiments, the invention provides methods method for reducing leaf temperature and enhancing transpiration in a plant, a plant leaf, or a plant cell, comprising increasing the number of stomatal pores in the epidermis of a plant, plant leaf, plant organ or plant part using a method of the invention.

In alternative embodiments, the plant is, or the guard cell, plant cell, plant part or plant organ, is isolated and/or derived from: (i) a dicotyledonous or monocotyledonous plant; (ii) wheat, oat, rye, barley, rice, sorghum, maize (corn), tobacco, a legume, a lupins, potato, sugar beet, pea, bean, soybean (soy), a cruciferous plant, a cauliflower, rape (or *rapa* or canola), cane (sugarcane), flax, cotton, palm, sugar beet, peanut, a tree, a poplar, a lupin, a silk cotton tree, desert willow, creosote bush, winterfat, balsa, ramie, kenaf, hemp, roselle, jute, or sisal abaca; or, (c) a species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus,* Man[iota]hot, *Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna* or *Zea.*

In alternative embodiments, the invention provides a transgenic guard cell, plant, plant cell, plant tissue, plant seed or fruit, plant part or plant organ, comprising:

(a) an heterologous serine endopeptidase, ATSBT5.2-like protein, subtilisin-like serine endopeptidase family protein or endopeptidase protein-expressing nucleic acid; or wherein optionally the nucleic acid, gene or transcript is operably linked to a plant expressible promoter, an inducible promoter, a constitutive promoter, a root specific promoter, a stomatal lineage stage-specific cell specific promoter, a guard cell specific promoter, a drought-inducible promoter, a stress-inducible promoter or a guard cell active promoter;

and optionally the nucleic acid, gene or transcript is stably integrated into the genome of the guard cell, plant, plant cell, plant tissue, plant seed or fruit, plant part or plant organ, or is contained in an episomal vector in the guard cell, plant, plant cell, plant tissue, plant seed or fruit, plant part or plant organ.

In alternative embodiments, the invention provides a transgenic guard cell, plant, plant cell, plant tissue, plant seed or fruit, plant part or plant organ, comprising:

(a) (1) a heterologous nucleic acid that is inhibitory to an serine endopeptidase, ATSBT5.2-like protein, subtilisin-like serine endopeptidase family protein or endopeptidase protein-expressing nucleic acid;

wherein optionally the inhibitory nucleic acid is operably linked to a plant expressible promoter, an inducible promoter, a constitutive promoter, a root specific promoter, a stomatal lineage stage-specific cell specific promoter, a guard cell specific promoter, a drought-inducible promoter, a stress-inducible promoter or a guard cell active promoter;

and optionally the inhibitory nucleic acid is stably integrated into the genome of the guard cell, plant, plant cell, plant tissue, plant seed or fruit, plant part or plant organ, or is contained in an episomal vector in the guard cell, plant, plant cell, plant tissue, plant seed or fruit, plant part or plant organ, and optionally the inhibitory nucleic acid comprises an antisense RNA, siRNA, miRNA or an iRNA or an artificial micro RNA.

In alternative embodiments, the invention provides a transgenic guard cell, plant, plant cell, plant tissue, plant seed or fruit, plant part or plant organ, comprising:

(a) a recombinant gene, wherein the recombinant gene comprises an expression-increasing recombinant gene or an expression-inhibiting recombinant gene;

wherein the expression increasing recombinant gene comprises:
    i. a plant, plant cell or guard cell expressible promoter, such as a heterologous promoter; and
    ii. a heterologous nucleic acid encoding an serine endopeptidase, ATSBT5.2-like protein, subtilisin-like serine endopeptidase family protein or endopeptidase protein; and optionally further comprising a transcription termination and polyadenylation signal; and wherein the expression-inhibiting recombinant gene comprises the following operably linked DNA fragments:
    i. a plant, plant cell or guard cell expressible promoter; and
    ii. a heterologous nucleic acid, which when transcribed produces a nucleic acid (e.g., a ribonucleic acid) inhibitory to the expression of a serine endopeptidase, ATSBT5.2-like protein, subtilisin-like serine endopeptidase family protein or endopeptidase protein-expressing nucleic acid, gene or transcript (mRNA), optionally further comprising a transcription termination and polyadenylation signal.

In alternative embodiments of a guard cell, plant, plant cell, plant tissue, plant seed or fruit, plant part or plant organ of the invention, the nucleic acid (e.g., a DNA or cDNA fragment) encoding a ATSBT5.2-like protein encodes a serine endopeptidase, ATSBT5.2-like protein, subtilisin-like serine endopeptidase family protein or endopeptidase protein comprising an amino acid sequence having between 75% and 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with (a) an amino acid sequence comprising or consisting any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72;

(b) an amino acid sequence comprising or consisting any one of the amino acid sequences of SEQ ID NO:2 or SEQ ID NO:4;

(c) an amino acid sequence comprising or consisting any one of the amino acid sequences of SEQ ID NO:5, SEQ ID NO:8, SEQ ID NO:17, SEQ ID NO:22, SEQ ID NO:40 or SEQ ID NO:53; or (d) a processed form (e.g., a "mature" form, e.g., a form lacking a signal sequence) of a protein of (a), (b) or (c).

In alternative embodiments of a guard cell, plant, plant cell, plant tissue, plant seed or fruit, plant part or plant organ of the invention, the serine endopeptidase, ATSBT5.2-like protein, subtilisin-like serine endopeptidase family protein or endopeptidase protein is encoded by a nucleotide sequence of SEQ ID NO:1.

In alternative embodiments, the nucleic acid (e.g., DNA or cDNA fragment), which when transcribed yields an inhibitory nucleic acid (e.g., an inhibitory ribonucleic acid, an siRNA, an miRNA or an artificial micro RNA) to the expression of a ATSBT5.2-like protein-expressing nucleic acid comprises a nucleotide sequence of at least 11, 12, 13, 14, 15, 16, 17, 18, or 19 or more nucleotides having at least 90%, 91%, 92%, 93%, 94%, 95%, 96%, 97%, 98% or 99% or more sequence identity with a nucleotide sequence encoding serine endopeptidase, ATSBT5.2-like protein, subtilisin-like serine endopeptidase family protein or endopeptidase protein comprising an amino acid sequence having between 75% and 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with (a) an amino acid sequence comprising or consisting any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72; or (b) an amino acid sequence comprising or consisting any one of the amino acid sequences of SEQ ID NO:2 or SEQ ID NO:4; or (c) an amino acid sequence comprising or consisting any one of the amino acid sequences of SEQ ID NO:5, SEQ ID NO:8, SEQ ID NO:17, SEQ ID NO:22, SEQ ID NO:40 or SEQ ID NO:53; or (d) a complete or partial complement thereof.

In alternative embodiments, the nucleic acid (e.g., DNA or cDNA fragment), which when transcribed yield a ribonucleic acid inhibitory to the expression of serine endopeptidase, ATSBT5.2-like protein, subtilisin-like serine endopeptidase family protein or endopeptidase protein-expressing nucleic acid comprises a nucleotide sequence of at least 11, 12, 13, 14, 15, 16, 17, 18, or 19 or more nucleotides having at least 94% sequence identity with a nucleotide sequence selected from the nucleotide sequence of (comprising) SEQ ID NO:1 or a complete or partial complement thereof.

In alternative embodiments, the ribonucleic acid inhibitory to the expression of an ATSBT5.2-like protein-expressing nucleic acid, or a serine endopeptidase, subtilisin-like serine endopeptidase family protein or endopeptidase protein expressing nucleic acid, comprises the nucleotide sequence of at least 11, 12, 13, 14, 15, 16, 17, 18, or 19 or more nucleotides and a complementary sequence to the nucleotide sequence of at least 11, 12, 13, 14, 15, 16, 17, 18, or 19 or more nucleotides. In alternative embodiments, the ribonucleic acid inhibitory to the expression of a serine endopeptidase, ATSBT5.2-like protein, subtilisin-like serine endopeptidase family protein or endopeptidase protein-expressing nucleic acid comprises the nucleotide sequence of at least 19 nucleotides and a complementary sequence to the nucleotide sequence of at least 19 nucleotides.

In alternative embodiments, the plant is or the guard cell, plant, plant cell, plant tissue, plant seed or fruit, plant part or plant organ is isolated and/or derived from: (i) a dicotyledonous or monocotyledonous plant; (ii) wheat, oat, rye, barley, rice, sorghum, maize (corn), tobacco, a legume, a lupins, potato, sugar beet, pea, bean, soybean (soy), a cruciferous plant, a cauliflower, rape (or *rapa* or canola), cane (sugarcane), flax, cotton, palm, sugar beet, peanut, a tree, a poplar, a lupin, a silk cotton tree, desert willow, creosote bush, winterfat, balsa, ramie, kenaf, hemp, roselle, jute, or sisal abaca; or, (c) a species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus,* Man[iota]hot, *Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna* or *Zea.*

In alternative embodiments, the invention provides methods for increasing or decreasing the stomatal cell density in a plant, plant part or plant organ, comprising providing cells of a guard cell, plant, plant cell, plant tissue, plant seed or fruit, plant part or plant organ with a recombinant gene, wherein the recombinant gene is selected from an expression increasing recombinant gene or an expression inhibiting a recombinant gene or nucleic acid (e.g., DNA or cDNA fragment) encoding a serine endopeptidase, ATSBT5.2-like protein, subtilisin-like serine endopeptidase family protein or endopeptidase protein, for a. regulating carbon dioxide and water exchange in a plant;
b. regulating water uptake or water loss in a plant;
c. regulating water use efficiency or drought tolerance in a plant;
d. regulating biomass accumulation in a plant; or
e. regulating leaf temperature and transpiration in a plant.

In alternative embodiments, the invention provides chimeric nucleic acids (e.g., DNA, cDNA, RNA), as described herein.

In alternative embodiments, the invention provides chimeric nucleic acids (e.g., DNA, cDNA, RNA) comprising the following operably linked fragments:

(a) a plant-expressible promoter (b) DNA region heterologous to said plant-expressible promoter which when transcribed yields an RNA, said RNA either encoding a comprising an amino acid sequence having between 75% and 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with an amino acid sequence comprising or consisting any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72; or comprising at least 19 consecutive nucleotides having at least 94% sequence identity with a nucleotide sequence encoding a polypeptide having between 75% and 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with an amino acid sequence comprising or consisting any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72; and optionally also comprising at least the complement of said 19 consecutive nucleotides; and optionally a transcription termination and polyadenylation signal functional in plant cells.

In alternative embodiments, the invention provides methods for making a plant cell with altered stomatal density, stomatal index and/or stomatal size, said method comprising providing a cell of a plant with a nucleic acid as described herein.

In alternative embodiments, the invention provides methods for making a plant, plant part or plant organ with altered stomatal cell density, said method comprising providing a cell of a plant with a nucleic acid as described herein to generate a transgenic cell; and regenerating a plant, plant part or plant organ from said transgenic plant cell.

In alternative embodiments, the invention provides methods for altering the stomatal cell density, comprising selecting a plant comprising a substitution, deletion or insertion of one or more nucleotides in an endogenous gene encoding an serine endopeptidase, ATSBT5.2-like protein, subtilisin-like serine endopeptidase family protein or endopeptidase protein. The plant or cells can be submitted to treatment with a mutagen prior to said selecting. The substitution, deletion or insertion can result in a non-functional protein or a truncated protein or no protein at all. The endogenous gene encoding a serine endopeptidase, ATSBT5.2-like protein, subtilisin-like serine endopeptidase family protein or endopeptidase protein encodes a polypeptide comprising an amino acid sequence can have between about 75% and 100% sequence identity with:

(a) an amino acid sequence comprising or consisting any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72; or (b) an amino acid sequence comprising or consisting any one of the amino acid sequences of SEQ ID NO:2 or SEQ ID NO:4; or (c) an amino acid sequence comprising or consisting any one of the amino acid sequences of SEQ ID NO:5, SEQ ID NO:8, SEQ ID NO:17, SEQ ID NO:22, SEQ ID NO:40 or SEQ ID NO: 53; or (d) a processed form (e.g., a "mature" form, e.g., a form lacking a signal sequence) of a protein of (a), (b) or (c).

In alternative embodiments, the invention provides a plant obtainable or obtained by a method of the invention.

In alternative embodiments, the invention provides a plant comprising a modified endogenous gene encoding a serine endopeptidase, ATSBT5.2-like protein, subtilisin-like serine endopeptidase family protein or endopeptidase protein comprising an amino acid sequence having between about 75% and 100% sequence identity with, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity with:

(a) an amino acid sequence comprising or consisting any one of the amino acid sequences of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72; or (b) an amino acid sequence comprising or consisting any one of the amino acid sequences of SEQ ID NO:2 or SEQ ID NO:4; or (c) an amino acid sequence comprising or consisting any one of the amino acid sequences of SEQ ID NO:5, SEQ ID NO:8, SEQ ID NO:17, SEQ ID NO:22, SEQ ID NO:40 or SEQ ID NO:53;

wherein said endogenous gene comprises a substitution, deletion or insertion of one or more nucleotides in an endogenous gene encoding a serine endopeptidase, ATSBT5.2-like protein, subtilisin-like serine endopeptidase family protein or endopeptidase protein and wherein said plant and wherein said substitution, deletion or insertion results in the translation of a non-functional protein or a truncated protein or no protein at all from said endogenous gene.

In alternative embodiments, the plant is different from, or is not, an *Arabidopsis thaliana*. In alternative embodiments, the plant is selected from:

(a) wheat, oat, rye, barley, rice, sorghum, maize (corn), tobacco, a legume, a lupins, potato, sugar beet, pea, bean, soybean (soy), oilseed rape, a cauliflower, rape (or *rapa* or canola), cane (sugarcane), flax, cotton, palm, sugar beet, peanut, a tree, a poplar, a lupin, a silk cotton tree, desert willow, creosote bush, winterfat, balsa, ramie, kenaf, hemp, roselle, jute, or sisal abaca; and/or, (b) a species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus,* Man[iota]hot, *Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna* or *Zea*.

In alternative embodiments, the invention provides methods for increasing the water use efficiency of a guard cell, a plant, plant leaf, plant organ or plant part; or increasing the rate of growth or biomass production in a plant, plant leaf, plant organ or plant part; or enhancing the carbon dioxide ($CO_2$) sensitivity of a plant, plant leaf, plant organ or plant part; or down-regulating or decreasing carbon dioxide ($CO_2$) and/or water exchange in a guard cell of a plant, plant leaf, plant organ or plant part; or decrease the uptake of $CO_2$; or increase the drought tolerance of a plant, plant leaf, plant organ or plant part; or decrease the heat resistance or tolerance of a plant, plant leaf, plant organ or plant part; or decrease the stomatal cell density of a plant, plant leaf, plant organ or plant part; all under conditions of increased atmospheric carbon dioxide comprising:

(a) in a cell of the plant, plant leaf, plant organ or plant part, or in a plant guard cell, increasing the expression and/or activity of a $CO_2$ sensor protein or a carbonic anhydrase;

(b) the method of (a) wherein the increasing of expression and/or activity of the $CO_2$ sensor protein or a carbonic anhydrase is by:

(1) providing a heterologous $CO_2$ sensor protein-expressing nucleic acid (e.g., a gene or message), or a carbonic anhydrase-expressing nucleic acid (e.g., a gene or message) and expressing the gene, message and/or protein in the guard cell, plant, plant leaf, plant organ or plant part; or (2) increasing of expression and/or activity of a homologous $CO_2$ sensor protein-expressing nucleic acid (e.g., a gene or message), or a homologous carbonic anhydrase-expressing nucleic acid (e.g., a gene or message); or, (3) a combination of (1) and (2); or (c) the method of (a) or (b), the carbonic anhydrase is a β-carbonic anhydrase thereby increasing the water use efficiency of the guard cell, plant, plant leaf, plant organ or plant part; or increasing the rate of growth or biomass production in the plant, plant leaf, plant organ or plant part; or enhancing the carbon dioxide ($CO_2$) sensitivity of the plant, plant leaf, plant organ or plant part; or down-regulating or decreasing carbon dioxide ($CO_2$) and/or water exchange in the guard cell of the plant, plant leaf, plant organ or plant part; or decreasing the uptake of $CO_2$; or increasing the drought tolerance; or decreasing the heat resistance or tolerance or decreasing the stomatal cell density of the plant, plant leaf, plant organ or plant part under conditions of increased atmospheric carbon dioxide.

In alternative embodiments, the invention provides methods for up-regulating or increasing carbon dioxide ($CO_2$) and/or water exchange in a guard cell, a plant, plant leaf, plant organ or plant part; decreasing the water use efficiency of a guard cell, a plant, plant leaf, plant organ or plant part; or decreasing or desensitizing the carbon dioxide ($CO_2$) sensitivity of a plant, plant leaf, plant organ or plant part; or upregulating or increasing carbon dioxide ($CO_2$) and/or water exchange in a guard cell of a plant, plant leaf, plant organ or plant part; or increase the uptake of $CO_2$; or decrease the drought tolerance of a plant, plant leaf, plant organ or plant part; or increase the heat resistance or tolerance of a plant, plant leaf, plant organ or plant part; or increase the stomatal cell density of a plant, plant leaf, plant organ or plant part under conditions of increased atmospheric carbon dioxide; comprising:

(a) in a cell of the plant, plant leaf, plant organ or plant part, or in a plant guard cell, decreasing the expression and/or activity of a nucleic acid expressing a $CO_2$ sensor protein or a carbonic anhydrase;

(b) the method of (a), wherein the decreasing of expression and/or activity of the a $CO_2$ sensor protein or a carbonic anhydrase is by:

(1) providing a heterologous antisense or iRNA for a $CO_2$ sensor protein or a carbonic anhydrase encoding nucleic acid (e.g., to decrease the expression or activity of a gene or message), or any nucleic acid inhibitory to the expression of the a $CO_2$ sensor protein or a carbonic anhydrase; and, expressing the inhibitory nucleic acid, the antisense or the iRNA in the guard cell, plant, plant leaf, plant organ or plant part;
(2) decreasing of expression and/or activity of a homologous a $CO_2$ sensor protein or a carbonic anhydrase (e.g., a gene or message); or,
(3) a combination of (1) and (2);
(c) the method of (a) or (b) wherein the carbonic anhydrase is a β-carbonic anhydrase
(d) the method of (a) or (b) or (c) wherein the carbonic anhydrase is carbonic anhydrase 1 and/or 4;
thereby up-regulating or increasing carbon dioxide ($CO_2$) and/or water exchange in the guard cell, plant, plant leaf, plant organ or plant part; decreasing the water use efficiency of the guard cell, plant, plant leaf, plant organ or plant part; or increasing the rate of growth or biomass production in the plant, plant leaf, plant organ or plant part; or decreasing (desensitizing) the carbon dioxide ($CO_2$) sensitivity of the plant, plant leaf, plant organ or plant part; or up-regulating or increasing carbon dioxide ($CO_2$) and/or water exchange in the guard cell of the plant, plant leaf, plant organ or plant part or increase the uptake of $CO_2$; or decrease the drought tolerance of the plant, plant leaf, plant organ or plant part; or increase the heat resistance or tolerance of the plant, plant leaf, plant organ or plant part or increase the stomatal cell density of a plant, plant leaf, plant organ or plant part under conditions of increased atmospheric carbon dioxide.

In alternative embodiments, the polypeptide has a carbonic anhydrase activity and comprises an amino acid sequence having between about 75% to 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with
an amino acid sequence of, or an amino acid sequence comprising: SEQ ID NO: 75, SEQ ID NO: 80, SEQ ID NO:82, SEQ ID NO:78, SEQ ID NO:88, SEQ ID NO:90, SEQ ID NO:92, SEQ ID NO:94, SEQ ID NO:96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116 or SEQ ID NO: 118; or
an amino acid sequence of (comprising) SEQ ID NO: 75, SEQ ID NO: 80 or SEQ ID NO: 82.

In alternative embodiments, the polypeptide having carbonic anhydrase activity is encoded by a nucleotide sequence comprising or consisting of
(a) any of the nucleotide sequences of SEQ ID NO: 73, SEQ ID NO: 74, SEQ ID NO: 79, SEQ ID NO:81; or
(b) any of the nucleotide sequences of SEQ ID NO: 77, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115 or SEQ ID NO: 117.

In alternative embodiments of any of the methods of the invention, the $CO_2$ sensor protein-expressing nucleic acid or gene, carbonic anhydrase-expressing nucleic acid, message or gene, and/or the protein kinase-expressing nucleic acid, message or gene, is operably linked to a plant expressible promoter, an inducible promoter, a constitutive promoter, a root specific promoter, a stomatal lineage stage-specific cell specific promoter, a guard cell specific promoter, a drought-inducible promoter, a stress-inducible promoter or a guard cell active promoter.

In alternative embodiments, the nucleic acid inhibitory to the expression of a $CO_2$ sensor protein-expressing nucleic acid or carbonic anhydrase-expressing nucleic acid comprises:
(a) a nucleotide sequence of at least about 11, 12, 13, 14, 15, 16, 17, 18, or 19 or more nucleotides having at least about 90%, 91%, 92%, 93%, 94%, 95%, 96%, 97%, 98% or 99% or more sequence identity with a nucleotide sequence encoding a polypeptide having carbonic anhydrase activity, the polypeptide optionally comprising an amino acid sequence having between about 75% and 100% sequence identity, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with an amino acid sequence of:
an amino acid sequence of, or an amino acid sequence comprising, SEQ ID NO: 75, SEQ ID NO: 80, SEQ ID NO: 82, SEQ ID NO: 78, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116 or SEQ ID NO: 118; or
an amino acid sequence of, or an amino acid sequence comprising, SEQ ID NO: 75, SEQ ID NO: 80 or SEQ ID NO: 82; and/or
(b) a partial or complete complementary sequence of the nucleotide sequence (a).

In alternative embodiments, the nucleic acid inhibitory to the expression of a $CO_2$ sensor protein-expressing nucleic acid comprises:
(a) a nucleotide sequence of at least about 11, 12, 13, 14, 15, 16, 17, 18, or 19 or more nucleotides having at least about 90%, 91%, 92%, 93%, 94%, 95%, 96%, 97%, 98% or 99% or more sequence identity with a nucleotide sequence of
any of the nucleotide sequences of SEQ ID NO: 73, SEQ ID NO: 74, SEQ ID NO: 79, SEQ ID NO:81; or
any of the nucleotide sequences of SEQ ID NO: 77, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115 or SEQ ID NO: 117; and/or
(b) a partial or complete complementary sequence of the nucleotide sequence (a).

In alternative embodiments, the nucleotide sequence comprising the at least about 11, 12, 13, 14, 15, 16, 17, 18, or 19 or more nucleotides is a nucleotide sequence comprising at least 50 or 100 or 300 nucleotides having between 75% to 100% sequence identity, or, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, to the nucleotide sequence encoding a polypeptide having a carbonic anhydrase activity.

In alternative embodiments, the invention provides methods for regulating or altering the water use efficiency of a guard cell, a plant, plant leaf, plant organ or plant part; or modulating the rate of growth or biomass production in a plant, plant leaf, plant organ or plant part; or modulating the carbon dioxide ($CO_2$) sensitivity of a plant, plant leaf, plant organ or plant part; or altering carbon dioxide ($CO_2$) and/or water exchange in a guard cell of a plant, plant leaf, plant organ or plant part; or altering the uptake of $CO_2$; or altering the drought tolerance of a plant, plant leaf, plant organ or plant part; or regulating the heat resistance or tolerance of a plant, plant leaf, plant organ or plant part; or modulating the stomatal cell density of a plant, plant leaf, plant organ or plant part; all under conditions of increased atmospheric carbon dioxide comprising:

(a) altering the expression and/or activity of a nucleic acid expressing:
(i) an serine endopeptidase, apoplastic subtilisin-like serine endopeptidase like protein, ATSBT5.2-like protein, subtilisin-like serine endopeptidase family protein or endopeptidase which is capable of cleaving or cleaves an EPF2 protein (Epidermal patterning factor 2) in a manner such that it facilitates EPF2 binding to an ERECTA receptor, or
(ii) an ATSBT5.2-like gene, cDNA or mRNA (message) encoding a polypeptide with an endopeptidase activity; according to a method of the invention; and
(b) altering the expression and/or activity of a $CO_2$ sensor protein or a carbonic anhydrase as described herein.

In alternative embodiments, the invention provides methods for:

regulating or altering the water use efficiency of a guard cell, a plant, plant leaf, plant organ or plant part;

modulating the rate of growth or biomass production in a plant, plant leaf, plant organ or plant part;

modulating the carbon dioxide ($CO_2$) sensitivity of a plant, plant leaf, plant organ or plant part;

altering carbon dioxide ($CO_2$) and/or water exchange in a guard cell of a plant, plant leaf, plant organ or plant part; or altering the uptake of $CO_2$;

altering the drought tolerance of a plant, plant leaf, plant organ or plant part;

regulating the heat resistance or tolerance of a plant, plant leaf, plant organ or plant part; or, modulating the stomatal cell density of a plant, plant leaf, plant organ or plant part; all under conditions of increased atmospheric carbon dioxide, comprising:

(a) altering the expression and/or activity of: a nucleic acid expressing an apoplastic subtilisin-like serine endopeptidase like protein (ATSBT5.2-like protein) which is capable of cleaving or cleaves an EPF2 protein (Epidermal patterning factor 2) or serine endopeptidase, apoplastic subtilisin-like serine endopeptidase like protein, ATSBT5.2-like protein, subtilisin-like serine endopeptidase family protein or endopeptidase gene, cDNA or mRNA (message) encoding a polypeptide with endopeptidase activity according to a method of the invention; and (b) altering the expression and/or activity of:
An OST1 (Open Stomata 1, also known as SnRK2.6) protein kinase-expressing nucleic acid or an OST1 protein kinase gene or mRNA (message) encoding a polypeptide with OST1 protein kinase activity; or a protein kinase SnRK2.2- or SnRK2.3-expressing nucleic acid or an SnRK2.2- or SnRK2.3 protein kinase gene or mRNA (message) encoding a polypeptide with SnRK2.2- or SnRK2.3 protein kinase activity (SnRK2 genes are SNF1 Related Protein Kinase Subfamily 2 genes) (SNF1 is "Sucrose non-fermenting 1").

In alternative embodiments, the polypeptide having OST1 protein kinase activity comprises an amino acid sequence has between about 75% to 100% sequence identity, or 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, with an amino acid sequence of (comprising) SEQ ID NO:84 or SEQ ID NO:86. The polypeptide having OST1 protein kinase activity can be encoded by a nucleotide sequence of (comprising) SEQ ID NO:83 or SEQ ID NO:85.

In alternative embodiments, the methods of the invention can further comprise the step of altering the expression and/or activity of a $CO_2$ sensor protein or a carbonic anhydrase used to practice the invention. The expression and/or activity of the serine endopeptidase, apoplastic subtilisin-like serine endopeptidase like protein, ATSBT5.2-like protein, subtilisin-like serine endopeptidase family protein or endopeptidase protein can be increased and expression and/or activity of a $CO_2$ sensor protein or a carbonic anhydrase can be increased. In alternative embodiments, the expression and/or activity of a serine endopeptidase, apoplastic subtilisin-like serine endopeptidase like protein, ATSBT5.2-like protein, subtilisin-like serine endopeptidase family protein or endopeptidase protein is decreased and expression and/or activity of a $CO_2$ sensor protein or a carbonic anhydrase is decreased. In alternative embodiments, the expression and/or activity of a serine endopeptidase, apoplastic subtilisin-like serine endopeptidase like protein, ATSBT5.2-like protein, subtilisin-like serine endopeptidase family protein or endopeptidase protein is increased and expression and/or activity of a $CO_2$ sensor protein or a carbonic anhydrase is decreased. In alternative embodiments, the expression and/or activity of a serine endopeptidase, apoplastic subtilisin-like serine endopeptidase like protein, ATSBT5.2-like protein, subtilisin-like serine endopeptidase family protein or endopeptidase protein is increased and expression and/or activity of ATSBT5.2-like protein is increased. In alternative embodiments, the expression and/or activity of a serine endopeptidase, apoplastic subtilisin-like serine endopeptidase like protein, ATSBT5.2-like protein, subtilisin-like serine endopeptidase family protein or endopeptidase protein is increased and expression and/or activity of OST1 protein kinase or protein kinase SnRK2.2- or SnRK2.3 is decreased. In alternative embodiments, the expression and/or activity of a serine endopeptidase, apoplastic subtilisin-like serine endopeptidase like protein, ATSBT5.2-like protein, subtilisin-like serine endopeptidase family protein or endopeptidase protein is decreased and expression and/or activity of OST1 protein kinase or protein kinase SnRK2.2- or SnRK2.3 is decreased.

In alternative embodiments, for any method of the invention:

(a) expression and/or activity of a serine endopeptidase, apoplastic subtilisin-like serine endopeptidase like protein, ATSBT5.2-like protein, subtilisin-like serine endopeptidase family protein or endopeptidase protein is increased; (b) expression and/or activity of OST1 protein kinase or protein kinase SnRK2.2- or SnRK2.3 is increased; and (c) expression and/or activity of a $CO_2$ sensor protein or a carbonic anhydrase is increased.

In alternative embodiments, for any method of the invention: expression and/or activity of a serine endopeptidase, apoplastic subtilisin-like serine endopeptidase like protein, ATSBT5.2-like protein, subtilisin-like serine endopeptidase family protein or endopeptidase protein is increased; expression and/or activity of OST1 protein kinase or protein kinase SnRK2.2- or SnRK2.3 is increased; and expression and/or activity of a $CO_2$ sensor protein or a carbonic anhydrase is decreased.

In alternative embodiments, for any method of the invention:

expression and/or activity of a serine endopeptidase, apoplastic subtilisin-like serine endopeptidase like protein, ATSBT5.2-like protein, subtilisin-like serine endopeptidase family protein or endopeptidase protein is increased; and expression and/or activity of OST1 protein kinase or protein kinase SnRK2.2- or SnRK2.3 is decreased; and/or expression and/or activity of a $CO_2$ sensor protein or a carbonic anhydrase is increased.

In alternative embodiments, of methods of the invention:
expression and/or activity of a serine endopeptidase, apoplastic subtilisin-like serine endopeptidase like protein, ATSBT5.2-like protein, subtilisin-like serine endopeptidase family protein or endopeptidase protein is decreased;

expression and/or activity of OST1 protein kinase or protein kinase SnRK2.2- or SnRK2.3 is increased; and/or expression and/or activity of a $CO_2$ sensor protein or a carbonic anhydrase is increased.

In alternative embodiments, of methods of the invention:
expression and/or activity of serine endopeptidase, apoplastic subtilisin-like serine endopeptidase like protein, ATSBT5.2-like protein, subtilisin-like serine endopeptidase family protein or endopeptidase protein is decreased; and/or expression and/or activity of OST1 protein kinase or protein kinase SnRK2.2- or SnRK2.3 is decreased; and/or expression and/or activity of a $CO_2$ sensor protein or a carbonic anhydrase is increased.

In alternative embodiments, of methods of the invention:
expression and/or activity of serine endopeptidase, apoplastic subtilisin-like serine endopeptidase like protein, ATSBT5.2-like protein, subtilisin-like serine endopeptidase family protein or endopeptidase protein is decreased; and/or expression and/or activity of OST1 protein kinase or protein kinase SnRK2.2- or SnRK2.3 is increased; and expression and/or activity of a $CO_2$ sensor protein or a carbonic anhydrase is decreased.

In alternative embodiments, of methods of the invention:
expression and/or activity of serine endopeptidase, apoplastic subtilisin-like serine endopeptidase like protein, ATSBT5.2-like protein, subtilisin-like serine endopeptidase family protein or endopeptidase protein is decreased; and expression and/or activity of OST1 protein kinase or protein kinase SnRK2.2- or SnRK2.3 is decreased; and expression and/or activity of a $CO_2$ sensor protein or a carbonic anhydrase is decreased.

In alternative embodiments, the invention provides methods for:
regulating or altering the water use efficiency of a guard cell, a plant, plant leaf, plant organ or plant part;

modulating the rate of growth or biomass production in a plant, plant leaf, plant organ or plant part;

modulating the carbon dioxide ($CO_2$) sensitivity of a plant, plant leaf, plant organ or plant part;

altering carbon dioxide ($CO_2$) and/or water exchange in a guard cell of a plant, plant leaf, plant organ or plant part;

altering the uptake of $CO_2$; or altering the drought tolerance of a plant, plant leaf, plant organ or plant part;

regulating the heat resistance or tolerance of a plant, plant leaf, plant organ or plant part; or, modulating the stomatal cell density of a plant, plant leaf, plant organ or plant part; all under conditions of increased atmospheric carbon dioxide, comprising:
expressing or overexpressing a $CO_2$ sensor protein or carbonic anhydrase used to practice a method of this invention, in a plant wherein the expression and/or activity of serine endopeptidase, apoplastic subtilisin-like serine endopeptidase like protein, ATSBT5.2-like protein, subtilisin-like serine endopeptidase family protein or endopeptidase protein is decreased; or expressing or overexpressing a $CO_2$ binding protein or carbonic anhydrase in a plant wherein the expression and/or activity of EPF2-like protein is decreased and/or increased.

In alternative embodiments, the invention provides kits comprising a compound or compounds used to practice the methods of the invention, and optionally instructions to practice a method of the invention.

The details of one or more embodiments of the invention are set forth in the accompanying drawings and the description below. Other features, objects, and advantages of the invention can be apparent from the description and drawings, and from the claims.

All publications, patents, patent applications cited herein are hereby expressly incorporated by reference for all purposes.

DESCRIPTION OF DRAWINGS

The drawings set forth herein are illustrative of embodiments of the invention and are not meant to limit the scope of the invention as encompassed by the claims.

Like reference symbols in the various drawings indicate like elements.

FIG. 18, or FIG. 1 of Example 3|Carbonic anhydrases CA1 and CA4 are required for repression of stomatal development at elevated $CO_2$. a, 21 day old ca1ca4 double mutant and wildtype (WT) plants grown at 150 ppm and 500 ppm $CO_2$. Scale bar, 2 cm. b, Confocal images of abaxial cotyledon epidermes of 10-day-old ca1ca4 and WT seedlings grown at 500 ppm $CO_2$. Scale bar, 100 µm, Stomatal index of 150 and 500 ppm $CO_2$-grown WT and ca1ca4 mutant seedlings, which show an inverted stomatal development response to elevated $CO_2$ d, Elevated $CO_2$-induced changes in stomatal index (data from c) shown as percent changes in stomatal index at 500 ppm $CO_2$ compared to 150 ppm $CO_2$. e, Stomatal density (data from c) for WT and the ca1ca4. f, Stomatal index for six independent lines of the ca1ca4 mutant transformed with genomic copies of either AtCa1 (CA1-G) or AtCa4 (CA4-G), show a repression of the elevated $CO_2$-induced increase in stomatal index of the ca1ca4 mutant. g, Elevated $CO_2$-induced changes in stomatal development for data in f. Statistical comparisons were made between $CO_2$ treatments (c and e) or compared to the WT (d) or the ca1ca4 mutant data (g). Stomatal density and index measurements were conducted on 10-day-old seedlings in all figures. Further described in Example 3, below.

FIG. 19, or FIG. 2 of Example 3|Mature guard cell targeted carbonic anhydrase catalytic activity suppresses stomatal development non-cell autonomously in ca1ca4. Altering rapid $CO_2$-induced stomatal movements and transpiration efficiency does not invert elevated $CO_2$-mediated control of stomatal development. a, Cartoon showing epidermal cell differentiation in an immature cotyledon. Green=differentiated epidermis with stomata (b); red=epidermal cells entering differentiation (c). b-c, Confocal images of mature (b) or developing stomata (c) in cotyledons 5 days after germination (DAG) for lines expressing the human CAII-YFP construct driven by the mature guard cell preferential pGC1 promoter[21], illustrating mature guard cell targeting of pGC1::CAII-YFP. d, Stomatal index of six independent lines of the ca1ca4 mutant transformed with either CA1-YFP or CA4-YFP showing suppression of the inverted stomatal development phenotype of the ca1ca4 mutant at elevated $CO_2$. e, $CO_2$-induced change in stomatal index (500 ppm vs. 150 ppm) of three independent lines of the ca1ca4 mutant complemented with guard cell preferential over-expression of a YFP fusion of the human alpha carbonic anhydrase II (b). In d and e significance of suppression was analyzed relative to ca1ca4. f, Stomatal index in WT Columbia and the ost1-3 mutant at low and elevated $CO_2$. All scale bars, 20 µm. Further described in Example 3, below.

FIG. 20, or FIG. 3 of Example 3|Epf2 expression is regulated by [$CO_2$] and is essential for $CO_2$ control of stomatal development. a, Normalized Epf2 mRNA levels in developing (5DAG) cotyledons of WT and ca1ca4 mutant seedlings showing induction at elevated $CO_2$ in WT, but not ca1ca4. Inset boxes show normalized RNA-Seq expression of EPF2 exons. b-d, MUTE expression correlates with the stomatal development phenotype of the ca1ca4 mutant. Confocal images showing MUTEpro::nucGFP expression (green) in developing (5DAG) cotyledons of WT (b) and ca1ca4 (c) plants. d, Quantitation of MUTEpro::nucGFP expressing cells in WT and 2 independent lines in the ca1ca4 mutant background. e, Stomatal index in WT and two independent mutant alleles of epf2 at low and elevated $CO_2$ demonstrating that epf2 mutants show an inversion of the elevated $CO_2$-mediated control of stomatal development. Scale bars, 100 µm. Further described in Example 3, below.

FIG. 21, or FIG. 4 of Example 3|Epf2 expression is regulated by [$CO_2$] and is essential for $CO_2$ control of stomatal development|A $CO_2$-regulated secreted *subtilis* in-like serine protease, CRSP, is a key mediator of elevated $CO_2$-regulated repression of stomatal development. a, Stomatal index of WT (C24) and the sdd1-1 mutant grown at low and elevated $CO_2$. b, Sequence and MS/MS spectrum of peptide identification from the leaf apoplastic proteome for the subtilisin-like serine protease AtSBT5.2 (CRSP). c, $CO_2$ control of SBT5.2 (CRSP) mRNA levels in developing (5DAG) cotyledons of WT and ca1ca4 mutant seedlings grown at low and elevated $CO_2$. d, Stomatal index of WT and two independent crsp (sbt5.2) mutant alleles at low and elevated $CO_2$. e, Change in relative fluorescence emitted over time upon cleavage of synthetic EPF2 peptide (syn-EPF2) by the CRSP protease in the presence or absence of protease inhibitors. Further described in Example 3, below.

FIG. 31: Graphically illustrates chloroplast-localized CA4-YFP could not clearly or completely complement the $CO_2$ insensitivity of ca1ca4 mutant plants. 31A) Confocal microscope images show YFP fluorescence of guard cell chloroplasts of wild type (Col) and ca1ca4 double mutant plants transformed with a chloroplast-targeting pGC1:: CplscA-CA4-YFP construct. 31B) Time-resolved stomatal conductance of three randomly selected independent ca1ca4 transgenic lines expressing CA4-YFP in chloroplasts. 31C) Normalized stomatal conductance shown in 31B. The Cplsca, chloroplast signal peptide, corresponding to the first N-terminal 55AA amino acids of chloroplast specific expressing CPISCA gene was used to target CA4-YFP to chloroplasts, as described in detail in Example 4, below.

FIG. 34: Graphically illustrates average leaf temperature of.

DETAILED DESCRIPTION

Figure 1A:
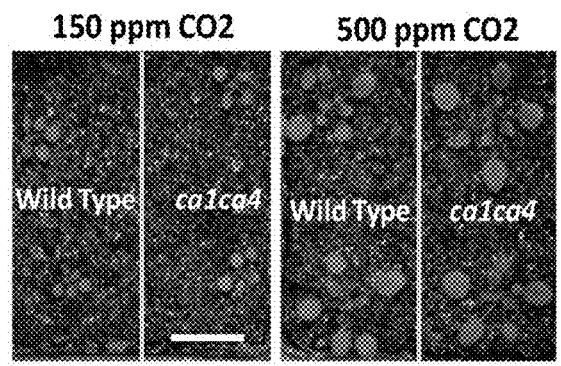
FIG. 1|Carbonic anhydrases AtCa1 and AtCa4 are required for repression of stomatal development at elevated $CO_2$. a, Photographs showing gross plant morphology of soil-grown 21 day old ca1ca4 double mutant and wild type plants grown continuously at 150 ppm and 500 ppm $CO_2$. Scale bar, 2 cm. b, Images of the abaxial cotyledon epidermes of 10 day old ca1ca4 and wild type seedlings grown at 500 ppm $CO_2$. Scale bar, 100 µm. c-e, Mutations in AtCa1 and AtCa4 cause an inverted stomatal development response to elevated $CO_2$ mediated repression of stomatal development. c, Bar graphs for stomatal indices of 10 day old wild type and ca1ca4 mutant seedlings grown at 150 and 500 ppm $CO_2$ (Stomatal Index=Percentage of epidermal cells which are stomata; S.I.=100*[Number of stomata]/[Number of stomata+Number of pavement cells]). d, Elevated $CO_2$-induced changes in stomatal index (data from c) for wild type and ca1ca4 mutant seedlings shown as percent changes in stomatal index at 500 ppm $CO_2$ compared to 150 ppm $CO_2$. e, Stomatal density (number of stomata per mm2; data from c) of 10 day old seedlings for three wild type and the ca1ca4 mutant. f, g, Complementation with genomic copies of either AtCa1 or AtCa4 represses the elevated $CO_2$-induced increase in stomatal index of ca1ca4 mutant leaves. f, Stomatal index of 10 day old seedlings for six independent lines of the ca1ca4 mutant complemented with genomic copies of either AtCa1 (CA1-G) or AtCa4 (CA4-G). Seedlings were grown simultaneously at 150 and 500 ppm $CO_2$. g, Quantitation of data shown in f for elevated $CO_2$-induced changes in stomatal index shown as percent changes in stomatal index at 500 ppm $CO_2$ relative to 150 ppm $CO_2$. For all figures: n=20 per genotype and $CO_2$ treatment (2 images each from 10 independent seedlings); error bars indicate standard error. Statistical analyses in all figures were conducted with the ORIGINPRO 8.6™ software package for individual genotypes between $CO_2$ treatments (c, e, f) or compared to the WT (d) or the ca1ca4 mutant data (g) using ANOVA and Tukey post tests. *=P<0.00005, =P<0.005, *=P<0.05.

In alternative embodiments, the invention provides compositions and methods for manipulating the exchange of water and carbon dioxide ($CO_2$) through plant stomata by controlling the expression and/or activity of an apoplastic subtilisin-like serine endopeptidase like protein which is capable of cleaving or cleaves EPF2 protein (Epidermal patterning factor 2), hereinafter referred as "ATSBT5.2-like protein" or a "CRSP protease" ($CO_2$-regulated secreted subtilisin-like serine protease (CRSP).

The invention provides compositions and methods for over or under-expressing ATSBT5.2-like protein or polypeptides. The invention provides compositions and methods for over-expressing ATSBT5.2-like protein, to engineer an improved $CO_2$ response in a plant, plant part, plant organ, a leaf, and the like.

While the invention is not based on any particular mechanism of action, embodiments of the invention are based on the elucidation of the mechanism for $CO_2$ control of gas exchange in plants. The inventors demonstrated that ATSBT5.2-like protein is involved in the decrease of stomatal cell density in response to elevated $CO_2$ concentration.

The inventors' analysis of ATSBT5.2-like protein (CRSP protease) ($CO_2$-regulated secreted subtilisin-like serine protease (CRSP) and $CO_2$ regulation of stomatal cell density demonstrate that the CRSP protease is a major regulator of $CO_2$-induced stomatal cell density decrease in the epidermis of plants leading to a new model for $CO_2$ control of gas exchange in plants and further possibilities to modulate the exchange of water and/or carbon dioxide ($CO_2$) through plant stomata.

Over-expression of ATSBT5.2 like protein genes evokes an improved $CO_2$ response. Thus, overexpression of ATSBT5.2 like protein enhances WUE and produces a more efficient and drought resistant plant, particularly in light of the continuously rising atmospheric $CO_2$ concentrations.

In alternative embodiments, the invention provides transgenic plants (including crop plants, such a field row plants), cells, plant tissues, seeds and organs, and the like, (which in alternative embodiments express one or more recombinant nucleic acids encoding an ATSBT5.2 like protein) which reduce their stomatal cell density to a greater extent than wild-type plants, thereby preserving their water usage. Because water use efficiency defines how well a plant can balance the loss of water through stomata with the net $CO_2$ uptake for photosynthesis, and hence its biomass accumulation, the compositions and methods of the invention can also be used to increase a plant's biomass, and thus the compositions and methods of the invention have applications in the biofuels/alternative energy area.

In alternative embodiments, the invention also provides compositions and methods for inhibiting the expression of ATSBT5.2 like protein encoding genes, transcripts and proteins using e.g. inhibitory RNA mediated repression (including antisense RNA, co-suppression RNA, siRNA, microRNA, double-stranded RNA, hairpin RNA and/or RNAi) of the expression of ATSBT5.2 like protein in cells, such as guard cells, in any plant including agricultural crops.

In alternative embodiments, the invention provides transgenic plants which have a lower expression of ATSBT5.2 like protein and can increase their stomatal cell density to a greater extent than wild-type plants.

In alternative embodiments, the invention provides plants, plant cells, plant organs and the like, e.g., agricultural crops, that can withstand increased temperatures—thus preventing a "breakdown" of metabolism, photosynthesis and growth. Thus, compositions and methods of this invention, by inhibiting both the expression of ATSBT5.2 like protein, help crops that otherwise would be sensitive to elevated temperatures to cope with the increased atmospheric $CO_2$ concentrations, also reducing or ameliorating an accelerated increase in leaf temperatures.

In alternative embodiments, the invention provides compositions and methods comprising inhibitory RNA (including antisense and RNAi) for repression of ATSBT5.2 like protein expression in guard cells or progenitor cells to reduce leaf temperature through enhancing transpiration in these crops and also to maximize crop yields.

In alternative embodiments, the invention provides compositions and methods for down-regulating/decreasing or alternatively increasing carbon dioxide ($CO_2$) and/or water exchange in a plant, e.g., through the guard cell of a plant, plant cell, plant leaf, plant organ or plant part comprising inter alia use of a ATSBT5.2 like polypeptide.

While the invention is not based on any particular mechanism of action, embodiments of compositions and methods of the invention are based on regulation of the stomatal cell density, including regulation of the efficiency of the exchange of water and $CO_2$ through stomata, can be modulated or balanced in a more controlled way by controlling ATSBT5.2 like protein expression and/or activity and/or transcripts thereby expressing or increasing the expression of ATSBT5.2 like protein and/or transcripts.

In alternative embodiments, the invention provides methods for down-regulating or decreasing carbon dioxide ($CO_2$) and/or water exchange in a guard cell of a plant, plant cell, plant leaf, plant organ or plant part comprising expressing in a cell a ATSBT5.2 like polypeptide.

As used herein ATSBT5.2 like protein or CRSP protease ($CO_2$-regulated secreted subtilisin-like serine protease (CRSP) refers to an apoplastic subtilisin-like serine endopeptidase like protein (ATSBT5.2-like protein) which is capable of cleaving or cleaves EPF2 protein (Epidermal patterning factor 2). An assay for determining the capacity to cleave EPF2 protein is described in the Examples section.

ATSBT5.2 like proteins suitable for the invention include an amino acid sequence comprising or consisting of any one of the amino acid sequences of SEQ ID NO:2 or SEQ ID NO:4, as can be derived from *Arabidopsis thaliana*.

In alternative embodiments, any ATSBT5.2 like protein can be used. Exemplary ATSBT5.2 like proteins that can be used to practice this invention include ATSBT5.2 like proteins isolated or derived which can be found in databases, and can be identified using algorithms searching for amino acid sequence which produce significant sequence alignments including:

| Accession | Description | Max score | Total score | Query coverage | E value | Max ident | SEQ ID |
|---|---|---|---|---|---|---|---|
| | Sequences producing significant alignments in *Triticum aestivum*: | | | | | | |
| CAJ75644.1 | subtilisin-like protease [*Triticum aestivum*] | 459 | 459 | 86% | 1e-152 | 42% | 5 |
| ACB87529.1 | subtilisin protease [*Triticum aestivum*] | 382 | 382 | 73% | 6e-125 | 40% | 6 |
| CAJ19363.1 | subtilisin-like protease [*Triticum aestivum*] | 255 | 420 | 76% | 4e-76 | 42% | 7 |
| | Sequences producing significant alignments in *Brachypodium distachyon*: | | | | | | |
| XP_003559397.1 | PREDICTED: subtilisin-like protease-like [*Brachypodium distachyon*] | 772 | 772 | 98% | 0.0 | 52% | 8 |
| | Sequences producing significant alignments in *Triticum aestivum*: | | | | | | |
| XP_003567246.1 | PREDICTED: subtilisin-like protease-like [*Brachypodium distachyon*] | 612 | 612 | 97% | 0.0 | 45% | 9 |
| XP_003578494.1 | PREDICTED: subtilisin-like protease SDD1-like [*Brachypodium distachyon*] | 530 | 530 | 95% | 7e-179 | 41% | 10 |
| XP_003569718.1 | PREDICTED: subtilisin-like protease-like [*Brachypodium distachyon*] | 523 | 523 | 95% | 4e-176 | 40% | 11 |
| XP_003571078.1 | PREDICTED: subtilisin-like protease-like [*Brachypodium distachyon*] | 511 | 511 | 97% | 3e-171 | 41% | 12 |
| XP_003559080.1 | PREDICTED: subtilisin-like protease-like [*Brachypodium distachyon*] | 492 | 492 | 90% | 4e-164 | 42% | 13 |
| XP_003576659.1 | PREDICTED: subtilisin-like protease-like [*Brachypodium distachyon*] | 491 | 491 | 94% | 8e-164 | 40% | 14 |
| XP_003558354.1 | PREDICTED: subtilisin-like protease-like [*Brachypodium distachyon*] | 489 | 489 | 90% | 4e-163 | 40% | 15 |
| XP_003581547.1 | PREDICTED: subtilisin-like protease-like [*Brachypodium distachyon*] | 486 | 486 | 90% | 1e-161 | 40% | 16 |
| | Sequences producing significant alignments in *Zea mays*: | | | | | | |
| NP_001145938.1 | uncharacterized protein LOC100279461 precursor [*Zea mays*] >gb|ACL52885.1| unknown [*Zea mays*] | 571 | 571 | 86% | 0.0 | 46% | 17 |
| NP_001159267.1 | uncharacterized protein LOC100304357 precursor [*Zea mays*] >gb|ACN25629.1| unknown [*Zea mays*] | 541 | 541 | 98% | 0.0 | 41% | 18 |
| NP_001169390.1 | uncharacterized protein LOC100383258 precursor [*Zea mays*] >gb|ACN33599.1| unknown [*Zea mays*] | 537 | 537 | 95% | 0.0 | 42% | 19 |
| ACN27710.1 | unknown [*Zea mays*] | 482 | 482 | 90% | 2e-161 | 41% | 20 |
| NP_001151755.1 | subtilisin-like protease precursor [*Zea mays*] >gb|ACG44232.1| subtilisin-like protease precursor [*Zea mays*] | 482 | 482 | 98% | 5e-160 | 38% | 21 |
| | Sequences producing significant alignments in *Oryza sativa*: | | | | | | |
| EAZ09528.1 | hypothetical protein OsI_31804 [*Oryza sativa* Indica Group] | 745 | 745 | 94% | 0.0 | 52% | 22 |
| EAY73513.1 | hypothetical protein OsI_01395 [*Oryza sativa* Indica Group] | 593 | 593 | 91% | 0.0 | 45% | 23 |
| BAA89562.1 | putative subtilisin-like protein [*Oryza sativa* Indica Group] | 591 | 591 | 91% | 0.0 | 45% | 24 |
| NP_001063751.1 | Os09g0530800 [*Oryza sativa* Japonica Group] >dbj|BAF25665.1| Os09g0530800 [*Oryza sativa* Japonica Group] >gb|EAZ45452.1| hypothetical protein OsJ_30103 [*Oryza sativa* Japonica Group] | 546 | 546 | 98% | 0.0 | 42% | 25 |
| EAZ09847.1 | hypothetical protein OsI_32138 [*Oryza sativa* Indica Group] | 543 | 543 | 98% | 0.0 | 42% | 26 |
| NP_001175897.1 | Os09g0482660 [*Oryza sativa* Japonica Group] >dbj|BAH94625.1| Os09g0482660 [*Oryza sativa* Japonica Group] | 521 | 521 | 66% | 2e-178 | 54% | 27 |

-continued

| Accession | Description | Max score | Total score | Query coverage | E value | Max ident | SEQ ID |
|---|---|---|---|---|---|---|---|
| EAY84890.1 | hypothetical protein OsI_06255 [*Oryza sativa* Indica Group] | 510 | 510 | 91% | 2e−170 | 43% | 28 |
| NP_01046210.1 | Os02g0198700 [*Oryza sativa Japonica* Group] >dbj|BAD25466.1| putative subtilisin-like proteinase AIR3 [*Oryza sativa Japonica* Group] >dbj|BAF08124.1| Os02g0198700 [*Oryza sativa Japonica* Group] | 510 | 510 | 91% | 2e−170 | 43% | 29 |
| EEE69917.1 | hypothetical protein OsJ_29768 [*Oryza sativa Japonica* Group] | 507 | 507 | 94% | 3e−169 | 41% | 30 |
| EEC71416.1 | hypothetical protein OsI_03596 [*Oryza sativa* Indica Group] | 504 | 504 | 94% | 2e−168 | 40% | 31 |
| BAB21149.1 | subtilisin-like proteinase-like [*Oryza sativa Japonica* Group] >dbj|BAB90087.1| subtilisin-like proteinase-like [*Oryza sativa Japonica* Group] | 504 | 504 | 94% | 3e−168 | 40% | 32 |
| NP_001050634.1 | Os03g0605300 [*Oryza sativa Japonica* Group] >gb|AAR87229.1| putative subtilisin-like proteinase [*Oryza sativa Japonica* Group] >gb|AAT78773.1| putative serine protease [*Oryza sativa Japonica* Group] >gb|ABF97524.1| cucumisin-like serine protease, putative, expressed [*Oryza sativa Japonica* Group] >dbj|BAF12548.1| Os03g0605300 [*Oryza sativa Japonica* Group] >gb|EAZ27735.1| hypothetical protein OsJ_11683 [*Oryza sativa Japonica* Group] | 493 | 493 | 90% | 3e−164 | 42% | 33 |
| EAZ01729.1 | hypothetical protein OsI23755 [*Oryza sativa* Indica Group] | 494 | 494 | 95% | 5e−164 | 40% | 34 |
| NP_001174909.1 | Os06g0624100 [*Oryza sativa Japonica* Group] >dbj|BAH93637.1| Os06g0624100 [*Oryza sativa Japonica* Group] | 499 | 499 | 95% | 1e−163 | 40% | 35 |
| NP_001051353.1 | Os03g0761500 [*Oryza sativa Japonica* Group] >gb|AAK63927.1|AC084282_8 putative serine protease [*Oryza sativa Japonica* Group] >gb|ABF99010.1| cucumisin-like serine protease, putative, expressed [*Oryza sativa Japonica* Group] >dbj|BAF13267.1| Os03g0761500 [*Oryza sativa Japonica* Group] >gb|EAZ28668.1| hypothetical protein OsJ_12679 [*Oryza sativa Japonica* Group] >dbj|BAG95169.1| unnamed protein product [*Oryza sativa Japonica* Group] >dbj|BAG95978.1| unnamed protein product [*Oryza sativa Japonica* Group] | 488 | 488 | 90% | 3e−162 | 42% | 36 |
| BAC22315.1 | putative subtilisin-like serine protease AIR3 [*Oryza sativa Japonica* Group] | 488 | 488 | 94% | 4e−162 | 39% | 37 |
| NP_001049524.2 | Os03g0242900 [*Oryza sativa Japonica* Group] >gb|ABF94911.1| subtilisin proteinase, putative, expressed [*Oryza sativa Japonica* Group] >gb|EAZ26232.1| hypothetical protein OsJ_10100 [*Oryza sativa Japonica* Group] >dbj|BAH01390.1| unnamed protein product [*Oryza sativa Japonica* Group] >dbj|BAF11438.2| Os03g0242900 [*Oryza sativa Japonica* Group] | 486 | 486 | 90% | 2e−161 | 40% | 38 |
| NP_001053614.1 | Os04g0573300 [*Oryza sativa Japonica* Group] >embCAD41662.3 OSJNBa0019K04.9 [*Oryza sativa Japonica* Group] >dbj|BAF15528.1| Os04g0573300 [*Oryza sativa Japonica* Group] >gb|EAZ31701.1| hypothetical protein OsJ_15851 [*Oryza sativa Japonica* Group] | 479 | 479 | 90% | 6e−159 | 41% | 39 |

-continued

| Accession | Description | Max score | Total score | Query coverage | E value | Max ident | SEQ ID |
|---|---|---|---|---|---|---|---|
| | Sequences producing significant alignments in *Solanum esculentum*: | | | | | | |
| NP_001234282.1 | SBT1 protein precursor [*Solanum lycopersicum*] >emb|CAA67429.1| SBT1 [*Solanum lycopersicum*] >emb|CAA06999.1| subtilisin-like protease [*Solanum lycopersicum*] | 502 | 502 | 97% | 2e−168 | 39% | 40 |
| NP_001234288.1 | SBT2 protein precursor [*Solanum lycopersicum*] >emb|CAA67430.1| SBT2 [*Solanum lycopersicum*] >emb|CAA07000.1| subtilisin-like protease [*Solanum lycopersicum*] | 469 | 469 | 90% | 8e−156 | 39% | 41 |
| NP_001233982.1 | subtilisin-like protease precursor [*Solanum lycopersicum*] >emb|CAA71234.1| subtilisin-like protease [*Solanum lycopersicum*] >emb|CAA76725.1| P69B protein [*Solanum lycopersicum*] | 461 | 484 | 94% | 4e−153 | 41% | 42 |
| CAB67119.1 | subtilisin-like protease [*Solanum lycopersicum*] | 460 | 460 | 98% | 2e−152 | 39% | 43 |
| CAB67120.1 | subtilisin-like protease [*Solanum lycopersicum*] | 453 | 453 | 98% | 5e−150 | 39% | 44 |
| CAA76727.1 | P69D protein [*Solanum lycopersicum*] | 452 | 476 | 94% | 2e−149 | 40% | 45 |
| CAA06412.1 | P69C protein [*Solanum lycopersicum*] | 452 | 476 | 94% | 2e−149 | 42% | 46 |
| CAA06414.1 | P69F protein [*Solanum lycopersicum*] | 451 | 474 | 94% | 5e−149 | 40% | 47 |
| CAA07250.1 | serine protease [*Solanum lycopersicum*] | 448 | 448 | 96% | 6e−148 | 39% | 48 |
| CAA06413.1 | P69E protein [*Solanum lycopersicum*] | 446 | 470 | 98% | 6e−147 | 39% | 49 |
| NP_001234257.1 | subtilisin-like endoprotease precursor [*Solanum lycopersicum*] >embCAA64566.1 subtilisin-like endoprotease [*Solanum lycopersicum*] >embCAA76724.1 P69A protein [*Solanum lycopersicum*] | 431 | 431 | 96% | 2e−141 | 38% | 50 |
| CAA07059.1 | SBT4B protein [*Solanum lycopersicum*] | 407 | 407 | 98% | 4e−132 | 36% | 51 |
| CAA76726.1 | P69C protein [*Solanum lycopersicum*] | 404 | 404 | 81% | 7e−132 | 41% | 52 |
| | Sequences producing significant alignments in *Glycine max*: | | | | | | |
| XP_003523384.1 | PREDICTED: subtilisin-like protease-like [*Glycine max*] | 872 | 872 | 95% | 0.0 | 60% | 53 |
| NP_001236511.1 | subtilisin-type protease precursor [*Glycine max*] >gb|AAK53065.1| subtilisin-type protease precursor [*Glycine max*] | 857 | 857 | 95% | 0.0 | 59% | 54 |
| AAK53589.1 | subtilisin-like protein [*Glycine max*] | 853 | 853 | 95% | 0.0 | 59% | 55 |
| XP_003523395.1 | PREDICTED: subtilisin-like protease like [*Glycine max*] | 850 | 850 | 95% | 0.0 | 57% | 56 |
| NP_001238252.1 | subtilisin-type protease precursor [*Glycine max*] >gb|AAG38994.1|AF160513_1 subtilisin-type protease precursor [*Glycine max*] >emb|CAB87246.1| putative pre-pro-subtilisin [*Glycine max*] >emb|CAB 87247.1| putative subtilisin precursor [*Glycine max*] | 789 | 789 | 95% | 0.0 | 56% | 57 |
| XP_003541562.1 | PREDICTED: subtilisin like protease like [*Glycine max*] | 640 | 640 | 98% | 0.0 | 45% | 58 |
| XP_003545787.1 | PREDICTED: subtilisin-like protease like [*Glycine max*] | 635 | 635 | 98% | 0.0 | 45% | 59 |
| XP_003537841.1 | PREDICTED: cucumisin-like [*Glycine max*] | 556 | 556 | 94% | 0.0 | 42% | 60 |
| XP_003524182.1 | PREDICTED: subtilisin-like protease SDD1-like [*Glycine max*] | 552 | 552 | 94% | 0.0 | 43% | 61 |
| XP_003534221.1 | PREDICTED: subtilisin-like protease like [*Glycine max*] | 546 | 546 | 94% | 0.0 | 41% | 62 |
| XP_003547892.1 | PREDICTED: subtilisin-like protease like [*Glycine max*] | 545 | 545 | 94% | 0.0 | 41% | 63 |
| XP_003539821.1 | PREDICTED: subtilisin like protease like [*Glycine max*] | 544 | 544 | 94% | 0.0 | 43% | 64 |
| XP_003538129.1 | PREDICTED: subtilisin-like protease like [*Glycine max*] | 537 | 537 | 94% | 0.0 | 43% | 65 |
| XP_003538919.1 | PREDICTED: subtilisin-like protease-like [*Glycine max*] | 526 | 526 | 97% | 2e−177 | 41% | 66 |

-continued

| Accession | Description | Max score | Total score | Query coverage | E value | Max ident | SEQ ID |
|---|---|---|---|---|---|---|---|
| Sequences producing significant alignments in *Glycine max*: | | | | | | | |
| XP_003516513.1 | PREDICTED: subtilisin-like protease-like [*Glycine max*] | 525 | 525 | 97% | 4e−177 | 40% | 67 |
| XP_003540860.1 | PREDICTED: subtilisin-like protease-like [*Glycine max*] | 520 | 520 | 90% | 1e−174 | 43% | 68 |
| XP_003538985.1 | PREDICTED: subtilisin-like protease-like [*Glycine max*] | 518 | 518 | 90% | 3e−174 | 43% | 69 |
| XP_003523991.1 | PREDICTED: subtilisin-like protease-like [*Glycine max*] | 518 | 518 | 99% | 3e−174 | 40% | 70 |
| XP_003538797.1 | PREDICTED: subtilisin-like protease-like [*Glycine max*] | 518 | 518 | 99% | 4e−174 | 41% | 71 |
| XP_003523496.1 | PREDICTED: subtilisin-like protease-like [*Glycine max*] | 514 | 514 | 90% | 1e−172 | 43% | 72 |

In alternative embodiments, ATSBT5.2 like protein encoding nucleic acids from any plant can be used to practice this invention; for example, a nucleic acid from any ATSBT5.2 like protein encoding gene of any plant can be used, including any ATSBT5.2 like protein-encoding nucleic acid sequence from any gene family of *Arabidopsis*, e.g., any ATSBT5.2 like protein-encoding nucleic acid sequence from an *Arabidopsis* family, e.g., from. *Arabidopsis thaliana*, can be used to practice the compositions and methods of this invention, such as the nucleic acid sequences encoding a polypeptide having the amino acid sequence of SEQ ID NO:2 or SEQ ID NO: 4. Such nucleotide sequences include the nucleotide sequence of SEQ ID NO:1 or SEQ ID NO: 2.

In alternative embodiments, ATSBT5.2 like protein encoding nucleic acids may be used having between 75% and 100% sequence identity to any of the nucleotide sequences above, which include those having 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a nucleotide sequence encoding an amino acid sequence of any of SEQ ID NO:2, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71 or SEQ ID. No.72, such as a nucleotide sequence having 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any nucleotide sequence of SEQ ID NO:1.

The compositions and methods described herein may be combined with composition and methods described in WO2008/134571 or PCT/EP12/22331 (both herein incorporated by reference) to further balance the stomatal cell density and stomatal aperture, and thus $CO_2$ and water exchange in response to different environmental cues.

The invention thus also provides in alternative embodiments, methods for regulating or altering the water use efficiency of a guard cell, a plant, plant leaf, plant organ or plant part; or modulating the rate of growth or biomass production in a plant, plant leaf, plant organ or plant part; or modulating the carbon dioxide ($CO_2$) sensitivity of a plant, plant leaf, plant organ or plant part; or altering carbon dioxide ($CO_2$) and/or water exchange in a guard cell of a plant, plant leaf, plant organ or plant part; or altering the uptake of $CO_2$; or altering the drought tolerance of a plant, plant leaf, plant organ or plant part; or regulating the heat resistance or tolerance of a plant, plant leaf, plant organ or plant part; or modulating the stomatal cell density of a plant, plant leaf, plant organ or plant part; all under conditions of increased atmospheric carbon dioxide comprising:

(a) altering the expression and/or activity of a nucleic acid expressing an apoplastic subtilisin-like serine endopeptidase like protein (ATSBT5.2-like protein) which is capable of cleaving or cleaves EPF2 protein (Epidermal patterning factor 2) or ATSBT5.2-like gene or mRNA (message) encoding a polypeptide with endopeptidase activity according to the methods of the invention; and (b) altering the expression and/or activity of a $CO_2$ sensor protein or a carbonic anhydrase according to the methods described in the invention; or (c) altering the expression and/or activity of a
 i. OST1 (Open Stomata 1, also known as SnRK2.6) protein kinase-expressing nucleic acid or an OST1 protein kinase gene or mRNA (message) encoding a polypeptide with OST1 protein kinase activity; or
 ii. a protein kinase SnRK2.2- or SnRK2.3-expressing nucleic acid or an SnRK2.2- or SnRK2.3 protein kinase gene or mRNA (message) encoding a polypeptide with SnRK2.2- or SnRK2.3 protein kinase activity (SnRK2 genes are SNF1 Related Protein Kinase Subfamily 2 genes) (SNF1 is "Sucrose non-fermenting 1").

In alternative embodiments, any carbonic anhydrase (carbonate dehydratase) can be used, e.g., including plant or bacterial carbonic anhydrase (carbonate dehydratase) enzymes. Exemplary carbonic anhydrase (carbonate dehydratase) enzymes that can be used to practice this invention include carbonic anhydrase (carbonate dehydratase) enzymes isolated or derived from:

Rice (Oryza sativa)
NM_001072713 (= Genbank accession number)
Oryza sativa (japonica cultivar-group) Os12g0153500 (Os12g0153500) mRNA, complete cds
gi|115487387|ref|NM_001072713.1|[1 15487387]
NM_001072308 (= Genbank accession number)
Oryza sativa (japonica cultivar-group) OsI_IgOl 53200 (OsI_IgOl 53200) mRNA, complete cds
gi|115484228|ref|NM_001072308.1|[1 15484228]
NM_001069944 (= Genbank accession number)
Oryza sativa (japonica cultivar-group) Os09g0464000 (Os09g0464000) mRNA, complete cds
gi|115479630|ref|NM_001069944.1|[1 15479630]
NM_001069887 (= Genbank accession number)
Oryza sativa (japonica cultivar-group) Os09g0454500 (Os09g0454500) mRNA, complete cds
gi|115479516|ref|NM_001069887.1|[1 15479516]
NM_001068550 (= Genbank accession number)
Oryza sativa (japonica cultivar-group) Os08g0470200 (Os08g0470200) mRNA, complete cds
gi|115476837|ref|NM_001068550.1 |[1 15476837]
NM_001068366 (= Genbank accession number)
Oryza sativa (japonica cultivar-group) Os08g0423500 (Os08g0423500) mRNA, complete cds
gi|115476469|ref|NM_001068366.1|[1 15476469]
NM_001064586 (= Genbank accession number)
Oryza sativa (japonica cultivar-group) Os06g0610100 (Os06g0610100) mRNA, complete cds
gi|115468903|ref|NM_001064586.1|[115468903]
NM_001053565 (= Genbank accession number)
Oryza sativa (japonica cultivar-group) Os02g0533300 (Os02g0533300) mRNA, complete cds
gi|115446500|ref|NM_001053565.1|[115446500]
NM00_1050212 (= Genbank accession number)
Oryza sativa (japonica cultivar-group) Os01g0640000 (Os01g0640000) mRNA, complete cds
gi|115438794|ref|NM_001050212.1|[1 15438794]
NM_001050211 (= Genbank accession number)
Oryza sativa (japonica cultivar-group) Os01g0639900 (OsO_Ig0639900) mRNA, partial cds
gi|115438792|ref|NM_001050211.11[115438792]
EF576561
Oryza sativa (indica cultivar-group) clone OSS-385-480-G10 carbonic anhydrase mRNA, partial cds
gi|149392692|gb|EF576561.1|[149392692]
AF182806
Oryza sativa carbonic anhydrase 3 mRNA, complete cds
gi|5917782|gb|AF182806.1|AF182806[5917782]
U08404
Oryza sativa chloroplast carbonic anhydrase mRNA, complete cds
gi|606816|gb|U08404.1|OSU08404[606816]

Corn: (Zea mays)
NM_001111889
Zea mays carbonic anhydrase (LOC542302), mRNA
gi|162459146|ref|NM_001111889.1|[162459146]
U08403
Zea mays Golden Bantam carbonic anhydrase mRNA, complete cds
gi|606814|gb|U08403.1 |ZMU08403 [606814]
U08401
Zea mays carbonic anhydrase mRNA, complete cds
gi|606810|gb|U08401.1|ZMU08401[606810]
M95073
Zea mays putative carbonic anhydrase homolog mRNA, partial cds gi|168561
|gb|M95073.1|MZEORFN[168561

Soybean:(Glycine max)
J239132
Glycine max mRNA for carbonic anhydrase
gi|4902524|emb|AJ239132.1|[4902524]

Tomato (Lycopersicon)
AJ849376
Lycopersicon esculentum mRNA for chloroplast carbonic anhydrase (ca2 gene)
gi|56562176|emb|AJ849376.1|[56562176]
AJ849375
Lycopersicon esculentum mRNA for carbonic anhydrase (ca1 gene)
gi|56562174|emb|AJ849375.1|[56562174]

Tobacco (Nicotiana)
AF492468

Nicotiana langsdorffii x Nicotiana sanderae nectarin III (NEC3) mRNA, complete cds
gi|29468279|gb|AF492468.1|[29468279]
AF454759
Nicotiana tabacum beta-carbonic anhydrase (CA) mRNA, complete cds; nuclear gene for chloroplast product
gi|22550385|gb|AF454759.2|[22550385]
AB009887
Nicotiana tabacum mRNA for carbonic anhydrase, partial cds
gi|8096276|dbj|AB009887.1|[8096276]
AB012863
Nicotiana paniculata mRNA for NPCA1, complete cds
gi|3061270|dbj|AB012863.1|[3061270]
L19255
Nicotiana tabacum chloroplastic carbonic anhydrase mRNA, 3' end
gi|310920|gb|L19255.1 |TOBCARANHY[310920]
M94135
Nicotiana tabacum chloroplast carbonic anhydrase gene, complete cds
gi|170218|gb|M94135.1|TOBCLCAA[170218]
AY974608
Nicotiana benthamiana clone 30F62 chloroplast carbonic anhydrase mRNA, partial cds; nuclear gene for chloroplast product
gi|62865756|gb|AY974608.1|[62865756]
AY974607
Nicotiana benthamiana clone 30C84 chloroplast carbonic anhydrase mRNA, partial cds; nuclear gene for chloroplast product
gi|62865754|gb|AY974607.1|[62865754]
AY974606

Nicotiana benthamiana clone 3 OB 10 chloroplast carbonic anhydrase mRNA, partial cds; nuclear gene for chloroplast product
gi|62865752|gb|AY974606.1|[62865752]

Barley (Hordeum)
L36959
Hordeum vulgare carbonic anhydrase mRNA, complete cds
gi|558498|gb|L36959.1|BLYCA[558498]

Cotton (Gossypium)
AF132855
Gossypium hirsutum carbonic anhydrase isoform 2 (C A2) mRNA, partial cds; nuclear gene for plastid product
gi|4754914|gb|AF132855.1|AF132855[4754914]
AF132854
Gossypium hirsutum carbonic anhydrase isoform 1 (CAl) mRNA, partial cds; nuclear gene for plastid product
gi|4754912|gb|AF132854.1|AF132854[4754912]

Poplar (Populus)
U55837
Populus tremula x Populus tremuloides carbonic anhydrase (CAIa) mRNA, nuclear gene encoding chloroplast protein, complete cds
gi|1354514|gb|U55837.1|PTU55837[1354514]
U55838
Populus tremula x Populus tremuloides carbonic anhydrase (CAIb) mRNA, nuclear gene encoding chloroplast protein, complete cds
gi|1354516|gb|U55838.1|PTU55838[1354516]

Cucumis
DQ641132
Cucumis sativus clone CU8F3 carbonic anhydrase mRNA, partial cds
gi|117663159|gb|DQ641132.1|[117663159]

Medicago
X93312
M. sativa mRNA for carbonic anhydrase
gi|1938226|emb|X93312.1|[1938226]

Phaseolus
AJ547634
Phaseolus vulgaris partial mRNA for carbonic anhydrase (ca gene)
gi|28556429|emb|AJ547634.1|[28556429]

Pisum
X52558
Pea cap mRNA for carbonic anhydrase (EC 4.2.1.1)
gi|20672|emb|X52558.1|[20672]
M63627

-continued

P. sativum carbonic anhydrase mRNA, complete cds
gi|169056|gb|M63627.1|PEACAMRA[169056]

Pyrus
AF 195204
Pyrus pyrifolia strain Whangkeumbae carbonic anhydrase isoform 1 (Ca11) mRNA, complete cds
gi|8698882|gb|AF195204.1|AF195204[8698882]

Prunus
EF640698
Prunus dulcis clone Pdbcs-E45 putative carbonic anhydrase mRNA, partial cds
gi|148807206|gb|EF640698.1|[148807206]

Vigna
AF139464
Vigna radiata carbonic anhydrase (CipCa1) mRNA, complete cds; nuclear gene for chloroplast product
gi|8954288|gb|AF139464.2|AF139464[8954288]

In alternative embodiments, carbonic anhydrase encoding nucleic acids from any carbonic anhydrase gene, e.g., including plant and bacterial genes, can be used to practice this invention; for example, a nucleic acid from any carbonic anhydrase gene of any plant can be used, including any carbonic anhydrase-encoding nucleic acid sequence from any gene family of Arabidopsis, e.g., any carbonic anhydrase-encoding nucleic acid sequence from an Arabidopsis family, e.g., from. Arabidopsis thaliana, can be used to practice the compositions and methods of this invention, such as the nucleic acid sequences encoding a polypeptide having the amino acid sequence of SEQ ID NO: 75, SEQ ID NO: 80, SEQ ID NO: 82, SEQ ID NO: 78, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116 or SEQ ID NO: 118. Such nucleotide sequences include the nucleotide sequence of SEQ ID NO: 77, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115 or SEQ ID NO: 117.

In alternative embodiments, carbonic anhydrases encoding nucleic acids may be used having between 75% and 100% sequence identity to any of the nucleotide sequences above, which include those having 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a nucleotide sequence encoding an amino acid sequence of any of SEQ ID NO: 75, SEQ ID NO: 80, SEQ ID NO: 82, SEQ ID NO: 78, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116 or SEQ ID NO: 118, such as a nucleotide sequence having 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any nucleotide sequence of SEQ ID NO: 77, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115 or SEQ ID NO: 117.

In alternative embodiments, OST1, SnRK2.2- or SnRK2.3 protein kinase encoding genes include genes encoding a polypeptide with OST1 protein kinase activity having between 75% and 100% sequence identity to the amino acid sequence of SEQ ID 12 or SEQ ID 14 including those having 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid sequence of SEQ ID NO:84 or SEQ ID NO:86. Such nucleotide sequences may have 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the nucleotide sequence of SEQ ID NO:83 or 85.

In alternative embodiments, compositions and methods of the invention comprise combinations, wherein the carbonic anhydrase can be either a β carbonic anhydrase 4 or a β carbonic anhydrase 1. In alternative embodiments, alternative (exemplary) combinations are:
i) Expressing, increasing the expression, upregulating a polypeptide with 13 carbonic anhydrase activity having an amino acid sequence sharing between 75% and 100% sequence identity to an amino acid of SEQ ID 79 (CA1) and expressing, increasing the expression or upregulating a ATSBT5.2-like polypeptide between 75% and 100% sequence identity to the amino acid sequence of SEQ ID 2;
ii) Expressing, increasing the expression, upregulating a polypeptide with (3 carbonic anhydrase activity having an amino acid sequence sharing between 75% and 100% sequence identity to an amino acid of SEQ ID 73 (CA4) and expressing, increasing the expression or upregulating an ATSBT5.2-like polypeptide sharing between 75% and 100% sequence identity to the amino acid sequence of SEQ ID 2.
iii) Reducing or down-regulating the expression of a polypeptide with 13 carbonic anhydrase activity having an amino acid sequence sharing between 75% and 100% sequence identity to an amino acid of SEQ ID 79 (CA1) and expressing, increasing the expression or upregulating a ATSBT5.2-like polypeptide sharing between 75% and 100% sequence identity to the amino acid sequence of SEQ ID 2 iv) Reducing or down-regulating the expression of a polypeptide with β carbonic anhydrase activity having an amino acid sequence sharing between 75% and 100% sequence identity to an amino acid of SEQ ID 73 (CA4) and expressing, increasing the expression or upregulating a ATSBT5.2-like polypeptide sharing between 75% and 100% sequence identity to the amino acid sequence of SEQ ID 2.

v) Increasing or upregulating the expression of a polypeptide with β carbonic anhydrase activity having an amino acid sequence sharing between 75% and 100% sequence identity to an amino acid of SEQ ID 79 (CA1) and expressing, reducing the expression or down regulating a ATSBT5.2-like polypeptide sharing between 75% and 100% sequence identity to the amino acid sequence of SEQ ID 2 vi) Increasing the expression or upregulating the expression of a polypeptide with β carbonic anhydrase activity having an amino acid sequence sharing between 75% and 100% sequence identity to an amino acid of SEQ ID 73 (CA4) and expressing and reducing or down-regulating a ATSBT5.2-like polypeptide sharing between 75% and 100% sequence identity to the amino acid sequence of SEQ ID 2.

vii) Reducing or down-regulating the expression of a polypeptide with β carbonic anhydrase activity having an amino acid sequence sharing between 75% and 100% sequence identity to an amino acid of SEQ ID 79 (CA1) and expressing, reducing the expression or down regulating a ATSBT5.2-like polypeptide sharing between 75% and 100% sequence identity to the amino acid sequence of SEQ ID 2 viii) Reducing or down-regulating or upregulating the expression of a polypeptide with β carbonic anhydrase activity having an amino acid sequence sharing between 75% and 100% sequence identity to an amino acid of SEQ ID 73 (CA4) and expressing and reducing or down-regulating a ATSBT5.2-like polypeptide sharing between 75% and 100% sequence identity to the amino acid sequence of SEQ ID 2.

ix) Expressing, increasing the expression, upregulating a polypeptide with β carbonic anhydrase activity having an amino acid sequence sharing between 75% and 100% sequence identity to an amino acid of SEQ ID 79 (CA1) or SEQ ID 73 and expressing, increasing the expression or upregulating a ATSBT5.2-like polypeptide between 75% and 100% sequence identity to the amino acid sequence of SEQ ID 2 and expressing, increasing the expression or upregulating a polypeptide with OST1 protein kinase having between 75% and 100% sequence identity to the amino acid sequence of SEQ ID 84 or SEQ ID No 86.

x) Expressing, increasing the expression, upregulating a polypeptide with β carbonic anhydrase activity having an amino acid sequence sharing between 75% and 100% sequence identity to an amino acid of SEQ ID 79 (CA1) or SEQ ID 73 and expressing, increasing the expression or upregulating a ATSBT5.2-like polypeptide between 75% and 100% sequence identity to the amino acid sequence of SEQ ID 2 and expressing, decreasing the expression or down-regulating a polypeptide with OST1 protein kinase having between 75% and 100% sequence identity to the amino acid sequence of SEQ ID 84 or SEQ ID No 86.

xi) Expressing, increasing the expression, upregulating a polypeptide with β carbonic anhydrase activity having an amino acid sequence sharing between 75% and 100% sequence identity to an amino acid of SEQ ID 79 (CA1) or SEQ ID 73 and expressing, decreasing the expression or down-regulating a ATSBT5.2-like polypeptide between 75% and 100% sequence identity to the amino acid sequence of SEQ ID 2 and expressing, increasing the expression or upregulating a polypeptide with OST1 protein kinase having between 75% and 100% sequence identity to the amino acid sequence of SEQ ID 84 or SEQ ID No 86.

xii) Decreasing the expression, down-regulating a polypeptide with β carbonic anhydrase activity having an amino acid sequence sharing between 75% and 100% sequence identity to an amino acid of SEQ ID 79 (CA1) or SEQ ID 73 and expressing, increasing the expression or upregulating a ATSBT5.2-like polypeptide between 75% and 100% sequence identity to the amino acid sequence of SEQ ID 2 and expressing, increasing the expression or upregulating a polypeptide with OST1 protein kinase having between 75% and 100% sequence identity to the amino acid sequence of SEQ ID 84 or SEQ ID No 86.

xiii) Decreasing the expression, down-regulating a polypeptide with β carbonic anhydrase activity having an amino acid sequence sharing between 75% and 100% sequence identity to an amino acid of SEQ ID 79 (CA1) or SEQ ID 73 and expressing, decreasing the expression or down-regulating a ATSBT5.2-like polypeptide between 75% and 100% sequence identity to the amino acid sequence of SEQ ID 2 and expressing, increasing the expression or upregulating a polypeptide with OST1 protein kinase having between 75% and 100% sequence identity to the amino acid sequence of SEQ ID 84 or SEQ ID No 86.

xiv) Decreasing the expression, down-regulating a polypeptide with β carbonic anhydrase activity having an amino acid sequence sharing between 75% and 100% sequence identity to an amino acid of SEQ ID 79 (CA1) or SEQ ID 73 and expressing, increasing the expression or upregulating a ATSBT5.2-like polypeptide between 75% and 100% sequence identity to the amino acid sequence of SEQ ID 2 and decreasing the expression or down-regulating a polypeptide with OST1 protein kinase having between 75% and 100% sequence identity to the amino acid sequence of SEQ ID 84 or SEQ ID No 86.

xv) Decreasing the expression, down-regulating a polypeptide with β carbonic anhydrase activity having an amino acid sequence sharing between 75% and 100% sequence identity to an amino acid of SEQ ID 79 (CA1) or SEQ ID 73 and expressing, decreasing the expression or down-regulating a ATSBT5.2-like polypeptide between 75% and 100% sequence identity to the amino acid sequence of SEQ ID 2 and expressing, decreasing the expression or down-regulating a polypeptide with OST1 protein kinase having between 75% and 100% sequence identity to the amino acid sequence of SEQ ID 84 or SEQ ID No 86.

In alternative embodiments, the invention provides combinations between upregulating one protein and down-regulating the expression of another protein, e.g., as set forth in the above paragraphs i) to xv), which can be made as described herein.

In alternative embodiments, expression or upregulating of the expression of a protein can be achieved by introduction (e.g., through transformation or crossing with a transgenic plant) of a recombinant gene comprising one, several or all of the following operably linked fragments i. a plant expressible promoter;
ii. an, optionally heterologous, DNA fragment encoding an ATSBT5.2-like polypeptide and
iii. optionally, a transcription termination and polyadenylation signal;

Plant (Expressible) Promoters

In alternative embodiments, nucleic acids, protein coding sequences or genes used to practice the invention is operably linked to a plant expressible promoter, an inducible promoter, a constitutive promoter, a guard cell specific promoter, a drought-inducible promoter, a stress-inducible promoter or a guard cell active promoter. Promoters used to practice the invention include a strong promoter, particularly in plant guard cells, and in some embodiments is guard cell specific, e.g., the promoters described in WO2008/134571.

In alternative embodiments, nucleic acids, protein coding sequences or genes also can be operatively linked to any constitutive and/or plant specific, or plant cell specific promoter, e.g., a cauliflower mosaic virus (CaMV) 35S promoter, a mannopine synthase (MAS) promoter, a 1' or 2' promoter derived from T-DNA of Agrobacterium tumefaciens, a figwort mosaic virus 34S promoter, an actin promoter, a rice actin promoter, a ubiquitin promoter, e.g., a maize ubiquitin-1 promoter, and the like.

Examples of constitutive plant promoters which can be useful for expressing the sequences in accordance with the invention include: the cauliflower mosaic virus (CaMV) 35S promoter, which confers constitutive, high-level expression in most plant tissues (see, e.g., Odell et al. (1985) Nature 313: 810-812); the nopaline synthase promoter (An et al. (1988) Plant Physiol. 88: 547-552); and the octopine synthase promoter (Fromm et al. (1989) Plant Cell 1: 977-984).

A variety of plant gene promoters that regulate gene expression in response to environmental, hormonal, chemical, developmental signals, and in a tissue-active manner can be used for expression of a sequence in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like.

Numerous known promoters have been characterized and can be employed to promote expression of a polynucleotide used to practice the invention, e.g., in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2Al 1 promoter (e.g., see U.S. Pat. No. 4,943,674) and the tomato polygalacturonase promoter (e.g., see Bird et al. (1988) Plant Mol. Biol. 11: 651-662), root-specific promoters, such as those disclosed in U.S. Pat. Nos. 5,618,988, 5,837,848 and 5,905,186, pollen-active promoters such as PTA29, PTA26 and PTA13 (e.g., see U.S. Pat. No. 5,792,929), promoters active in vascular tissue (e.g., see Ringli and Keller (1998) Plant Mol. Biol. 37: 977-988), flower-specific (e.g., see Kaiser et al. (1995) Plant Mol. Biol. 28: 231-243), pollen (e.g., see Baerson et al. (1994) Plant Mol. Biol. 26: 1947-1959), carpels (e.g., see Ohl et al. (1990) Plant Cell 2, pollen and ovules (e.g., see Baerson et al. (1993) Plant Mol. Biol. 22: 255-267), auxin-inducible promoters (such as that described in van der Kop et al. (1999) Plant Mol. Biol. 39: 979-990 or Baumann et al., (1999) Plant Cell 11: 323-334), cytokinin-inducible promoter (e.g., see Guevara-Garcia (1998) Plant Mol. Biol. 38: 743-753), promoters responsive to gibberellin (e.g., see Shi et al. (1998) Plant Mol. Biol. 38: 1053-1060, Willmott et al. (1998) Plant Molec. Biol. 38: 817-825) and the like.

Additional promoters that can be used to practice this invention are those that elicit expression in response to heat (e.g., see Ainley et al. (1993) Plant Mol. Biol. 22: 13-23), light (e.g., the pea rbcS-3A promoter, Kuhlemeier et al. (1989) Plant Cell 1: 471-478, and the maize rbcS promoter, Schaffher and Sheen (1991) Plant Cell 3: 997-1012); wounding (e.g., wunl, Siebertz et al. (1989) Plant Cell 1: 961-968); pathogens (such as the PR-I promoter described in Buchel et al. (1999) Plant Mol. Biol. 40: 387-396, and the PDF 1.2 promoter described in Manners et al. (1998) Plant Mol. Biol. 38: 1071-1080), and chemicals such as methyl jasmonate or salicylic acid (e.g., see Gatz (1997) Annu. Rev. Plant Physiol. Plant Mol. Biol. 48: 89-108). In addition, the timing of the expression can be controlled by using promoters such as those acting at senescence (e.g., see Gan and Amasino (1995) Science 270: 1986-1988); or late seed development (e.g., see Odell et al. (1994) Plant Physiol. 106: 447-458).

In alternative embodiments, tissue-specific and/or developmental stage-specific promoters are used, e.g., promoter that can promote transcription only within a certain time frame of developmental stage within that tissue. See, e.g., Blazquez (1998) Plant Cell 10:791-800, characterizing the Arabidopsis LEAFY gene promoter. See also Cardon (1997) Plant J 12:367-77, describing the transcription factor SPL3, which recognizes a conserved sequence motif in the promoter region of the A. thaliana floral meristem identity gene API; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells, hi one aspect, the nucleic acids of the invention are operably linked to a promoter active primarily during the stages of cotton fiber cell elongation, e.g., as described by Rinehart (1996) supra. The nucleic acids can be operably linked to the Fb12A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF 13 promoter from Agrobacterium rhizogenes (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BELL gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

In alternative embodiments, plant promoters which are inducible upon exposure to plant hormones, such as auxins, are used to express the nucleic acids used to practice the invention. For example, the invention can use the auxin-response elements El promoter fragment (AuxREs) in the soybean {Glycine max L.) (Liu (1997) Plant Physiol. 115: 397-407); the auxin-responsive Arabidopsis GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) MoI. Plant Microbe Interact. 10:933-937); and, the promoter responsive to the stress hormone abscisic acid (Sheen (1996) Science 274:1900-1902).

In alternative embodiments, nucleic acids used to practice the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the Avena sativa L. (oat) arginine decarboxylase gene (Masgrau (1997) Plant J. 11:465-473); or, a salicylic acid-responsive element (Stange (1997) Plant J. 11:1315-1324). Using chemically-{e.g., hormone- or pesticide-) induced promoters, i.e., promoter responsive to a chemical which can be applied to the transgenic plant in the field, expression of a polypeptide of the invention can be induced at a particular stage of development of the plant.

In alternative embodiments, the invention also provides for transgenic plants containing an inducible gene encoding for polypeptides used to practice the invention whose host range is limited to target plant species, such as corn, rice, barley, wheat, potato or other crops, inducible at any stage of development of the crop.

In alternative embodiments, a tissue-specific plant promoter may drive expression of operably linked sequences in tissues other than the target tissue. In alternative embodiments, a tissue-specific promoter that drives expression preferentially in the target tissue or cell type, but may also lead to some expression in other tissues as well, is used.

In alternative embodiments, proper polypeptide expression may require polyadenylation region at the 3'-end of the coding region. The polyadenylation region can be derived from the natural gene, from a variety of other plant (or animal or other) genes, or from genes in the Agrobacterial T-DNA.

Antisense Inhibitory Molecules

In alternative embodiments, downregulation of ATSBT5.2-like protein genes, $CO_2$ sensor genes or OST1, SnRK2.2 or SnRK2.3 genes or transcripts can be achieved by introduction of a recombinant gene expressing inhibitory RNA targeted towards ATSBT5.2-like protein genes, $CO_2$ sensor genes or OST1, either separately or together.

In alternative embodiments, the invention provides an antisense inhibitory molecules comprising a sequence used to practice this invention (which include both sense and antisense strands), e.g., which target ATSBT5.2-like protein genes, $CO_2$ sensor genes or OST1, SnRK2.2 or SnRK2.3 genes or transcripts. Naturally occurring or synthetic nucleic acids can be used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Pharmacol 144: 189-197; Antisense Therapeutics, ed. Agrawal (Humana Press, Totowa, N.J., 1996). Antisense oligonucleotides having synthetic DNA backbone analogues provided by the invention can also include phosphoro-dithioate, methyl-phosphonate, phosphoramidate, alkyl phosphotriester, sulfamate, 3'-thioacetal, methylene(methylimino), 3'-N-carbamate, and morpholino carbamate nucleic acids, as described above.

RNA Interference (RNAi)

In one aspect, the invention provides an RNA inhibitory molecule, a so-called "RNAi" molecule, comprising a sequence used to practice this invention. In alternative embodiments, the RNAi molecule comprises a double-stranded RNA (dsRNA) molecule. The RNAi molecule can comprise a double-stranded RNA (dsRNA) molecule, e.g., siRNA, miRNA (microRNA), an artificial micro RNA, and/or short hairpin RNA (shRNA) molecules. The RNAi molecule, e.g., siRNA (small inhibitory RNA), miRNA, or an artificial micro RNA, can inhibit expression of a ATSBT5.2-like protein gene, $CO_2$Sen genes or OST1 genes, and/or miRNA (micro RNA) to inhibit translation of a serine endopeptidase, apoplastic subtilisin-like serine endopeptidase like protein, ATSBT5.2-like protein, subtilisin-like serine endopeptidase family protein or endopeptidase, $CO_2$Sen gene or OST1 gene.

In alternative aspects, the RNAi is about 11, 12, 13, 14, 15, 16, 17, 18, 19, 20, 21, 22, 23, 24, 25 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi, e.g., siRNA for inhibiting transcription and/or miRNA to inhibit translation, is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's of the invention. The process may be practiced in vitro, ex vivo or in vivo. In one aspect, the RNAi molecules of the invention can be used to generate a loss-of-function mutation in a cell, an plant tissue or organ or seed, or a plant.

In alternative embodiments, intracellular introduction of the RNAi (e.g., miRNA, artificial micro RNA or siRNA) is by internalization of a target cell specific ligand bonded to an RNA binding protein comprising an RNAi (e.g., micro-RNA) is adsorbed. The ligand is specific to a unique target cell surface antigen. The ligand can be spontaneously internalized after binding to the cell surface antigen. If the unique cell surface antigen is not naturally internalized after binding to its ligand, internalization can be promoted by the incorporation of an arginine-rich peptide, or other membrane permeable peptide, into the structure of the ligand or RNA binding protein or attachment of such a peptide to the ligand or RNA binding protein. See, e.g., U.S. Patent App. Pub. Nos. 20060030003; 20060025361; 20060019286; 20060019258. hi one aspect, the invention provides lipid-based formulations for delivering, e.g., introducing nucleic acids of the invention as nucleic acid-lipid particles comprising an RNAi molecule to a cell, see e.g., U.S. Patent App. Pub. No. 20060008910.

In alternative embodiments, methods for making and using RNAi molecules, e.g., siRNA, artificial micro RNA and/or miRNA, for selectively degrade RNA include, e.g., U.S. Pat. Nos. 6,506,559; 6,511,824; 6,515,109; 6,489,127.

In alternative embodiments, known and routine methods for making expression constructs, e.g., vectors or plasmids, from which an inhibitory polynucleotide (e.g., a duplex siRNA of the invention) is transcribed are used. A regulatory region (e.g., promoter, enhancer, silencer, splice donor, acceptor, etc.) can be used to transcribe an RNA strand or RNA strands of an inhibitory polynucleotide from an expression construct. When making a duplex siRNA (e.g., to a ATSBT5.2-like protein gene, a $CO_2$Sen gene, or OST1, SnRK2.2 or SnRK2.3 gene) inhibitory molecule, the sense and antisense strands of the targeted portion of the targeted IRES can be transcribed as two separate RNA strands that will anneal together, or as a single RNA strand that will form a hairpin loop and anneal with itself.

For example, in alternative embodiments, a construct targeting a portion of an ATSBT5.2-like protein gene, a $CO_2$Sen gene or OST1, SnRK2.2 or SnRK2.3 gene is inserted between two promoters (e.g., two plant, viral, bacteriophage T7 or other promoters) such that transcription occurs bidirectionally and will result in complementary RNA strands that may subsequently anneal to form an inhibitory siRNA of the invention. Alternatively, a targeted portion of an ATSBT5.2-like protein gene, a $CO_2$Sen gene or OST1, SnRK2.2 or SnRK2.3 can be designed as a first and second coding region together on a single expression vector, wherein the first coding region of the targeted gene is in sense orientation relative to its controlling promoter, and wherein the second coding region of the gene is in antisense orientation relative to its controlling promoter. If transcription of the sense and antisense coding regions of the targeted portion of the targeted gene occurs from two separate promoters, the result may be two separate RNA strands that may subsequently anneal to form a gene or inhibitory siRNA, e.g., an ATSBT5.2-like protein gene, a $CO_2$Sen gene- or OST1, SnRK2.2 or SnRK2.3 gene inhibitory siRNA used to practice the invention.

In alternative embodiments, transcription of the sense and antisense targeted portion of the targeted nucleic acid, e.g., an ATSBT5.2-like protein gene $CO_2$Sen gene or OST1, SnRK2.2 or SnRK2.3 gene, is controlled by a single promoter, and the resulting transcript can be a single hairpin RNA strand that is self-complementary, e.g., forms a duplex by folding back on itself to create a (e.g., ATSBT5.2-like protein gene, $CO_2$Sen gene- or OST1, SnRK2.2 or SnRK2.3 gene)-inhibitory siRNA molecule. In this configuration, a spacer, e.g., of nucleotides, between the sense and antisense coding regions of the targeted portion of the targeted (e.g., ATSBT5.2-like protein, $CO_2$Sen gene- or OST1, SnRK2.2 or SnRK2.3) gene can improve the ability of the single strand RNA to form a hairpin loop, wherein the hairpin loop comprises the spacer. In one embodiment, the spacer comprises a length of nucleotides of between about 5 to 50 nucleotides. In one aspect, the sense and antisense coding regions of the siRNA can each be on a separate expression vector and under the control of its own promoter.

Inhibitory Ribozymes

In alternative embodiments, the invention provides ribozymes capable of binding ATSBT5.2-like protein, $CO_2$ sensor and/or OST1, SnRK2.2 or SnRK2.3 coding sequence, gene or message. These ribozymes can inhibit gene activity by, e.g., targeting mRNA.

Strategies for designing ribozymes and selecting the gene specific antisense sequence for targeting are well described in the scientific and patent literature, and the skilled artisan can design such ribozymes using the reagents and sequences used to practice this invention.

Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly Plants Comprising Nucleic Acids of this Invention In alternative embodiments, the invention provides transgenic plants, plant parts, plant organs or tissue, and seeds comprising nucleic acids, polypeptides, expression cassettes or vectors or a transfected or transformed cell of the invention. The invention also provides plant products, e.g., seeds, leaves, extracts and the like, comprising a nucleic acid and/or a polypeptide according to the invention. In alternative embodiments, the transgenic plant can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs used to practice the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's ATSBT5.2-like protein or $CO_2$Sen protein production is regulated by endogenous transcriptional or translational control elements, or by a heterologous promoter, e.g., a promoter of this invention. The invention also provides "knockout plants" where insertion of gene sequence by, e.g., homologous recombination, has disrupted the expression of the endogenous gene. Means to generate "knockout" plants are well-known in the art.

The nucleic acids and polypeptides used to practice the invention can be expressed in or inserted in any plant, plant part, plant cell or seed. Transgenic plants of the invention, or a plant or plant cell comprising a nucleic acid used to practice this invention (e.g., a transfected, infected or transformed cell) can be dicotyledonous or monocotyledonous. Examples of monocots comprising a nucleic acid of this invention, e.g., as monocot transgenic plants of the invention, are grasses, such as meadow grass (blue grass, Poa), forage grass such as *festuca, lolium*, temperate grass, such as *Agrostis*, and cereals, e.g., wheat, oats, rye, barley, rice, sorghum, and maize (corn). Examples of dicots comprising a nucleic acid of this invention, e.g., as dicot transgenic plants of the invention, are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, plant or plant cell comprising a nucleic acid of this invention, including the transgenic plants and seeds of the invention, include a broad range of plants, including, but not limited to, species from the genera *Anacardium, Arachis, Asparagus, Atropa, Avena, Brassica, Citrus, Citrullus, Capsicum, Carthamus, Cocos, Cojfea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solarium, Sorghum, Theobromus, Trigonella, Triticum, Vicia, Vitis, Vigna,* and *Zea*.

The nucleic acids and polypeptides used to practice this invention can be expressed in or inserted in any plant cell, organ, seed or tissue, including differentiated and undifferentiated tissues or plants, including but not limited to roots, stems, shoots, cotyledons, epicotyl, hypocotyl, leaves, pollen, seeds, tumor tissue and various forms of cells in culture such as single cells, protoplast, embryos, and callus tissue. The plant tissue may be in plants or in organ, tissue or cell culture.

Transgenic Plants

In alternative embodiments, the invention provides transgenic plants, plant cells, organs, seeds or tissues, comprising and expressing the nucleic acids used to practice this invention, e.g., ATSBT5.2-like protein genes, $CO_2$Sen genes and proteins and OST1, SnRK2.2 or SnRK2.3 genes; for example, the invention provides plants, e.g., transgenic plants, plant cells, organs, seeds or tissues that show improved growth under limiting water conditions; thus, the invention provides drought-tolerant plants, plant cells, organs, seeds or tissues (e.g., crops).

A transgenic plant of this invention can also include the machinery necessary for expressing or altering the activity of a polypeptide encoded by an endogenous gene, for example, by altering the phosphorylation state of the polypeptide to maintain it in an activated state.

Transgenic plants (or plant cells, or plant explants, or plant tissues) incorporating the polynucleotides used to practice the invention and/or expressing the polypeptides used to practice the invention can be produced by a variety of well-established techniques as described above.

Following construction of a vector, most typically an expression cassette, including a polynucleotide, e.g., encoding a transcription factor or transcription factor homolog, of the invention, standard techniques can be used to introduce the polynucleotide into a plant, a plant cell, a plant explant or a plant tissue of interest. In one aspect the plant cell, explant or tissue can be regenerated to produce a transgenic plant.

The plant can be any higher plant, including gymnosperms, monocotyledonous and dicotyledonous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al., eds., (1984) Handbook of Plant Cell Culture—Crop Species, Macmillan Publ. Co., New York, N.Y.; Shimamoto et al. (1989) Nature 338: 274-276; Fromm et al. (1990) Bio/Technol. 8: 833-839; and Vasil et al. (1990) Bio/Technol. 8: 429-434.

Transformation and regeneration of both monocotyledonous and dicotyledonous plant cells is now routine, and the selection of the most appropriate transformation technique can be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and In alternative embodiments, the invention uses *Agrobacterium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and include for example: U.S. Pat. Nos. 5,571, 706; 5,677,175; 5,510,471; 5,750,386; 5,597,945; 5,589, 615; 5,750,871; 5,268,526; 5,780,708; 5,538,880; 5,773, 269; 5,736,369 and 5,619,042.

In alternative embodiments, following transformation, plants are selected using a dominant selectable marker incorporated into the transformation vector. Such a marker can confer antibiotic or herbicide resistance on the transformed plants, and selection of transformants can be accomplished by exposing the plants to appropriate concentrations of the antibiotic or herbicide.

In alternative embodiments, after transformed plants are selected and grown to maturity, those plants showing a modified trait are identified. The modified trait can be any of those traits described above. In alternative embodiments, to confirm that the modified trait is due to changes in expression levels or activity of the transgenic polypeptide or polynucleotide can be determined by analyzing mRNA expression using Northern blots, RT-PCR or microarrays, or protein expression using immunoblots or Western blots or gel shift assays.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's $CO_2$ sensor production is regulated by endogenous transcriptional or translational control elements.

In alternative embodiments, the invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

In alternative embodiments, making transgenic plants or seeds comprises incorporating sequences used to practice the invention and, in one aspect (optionally), marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant MoI. Biol. 35:197-203; Pawlowski (1996) MoI. Biotechnol. 6:17-30; Klein (1987) Nature 327: 70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In alternative embodiments, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

In alternative embodiments, a third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., Protoplasts Isolation and Culture, Handbook of Plant Cell Culture, pp. 124-176, MacMillilan Publishing Company, New York, 1983; and Binding, Regeneration of Plants, Plant Protoplasts, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

In alternative embodiments, after the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides, e.g., an ATSBT5.2-like polypeptide, a $CO_2$ sensor and OST1, SnRK2.2 or SnRK2.3 gene of the invention. The desired effects can be passed to future plant generations by standard propagation means.

The invention will be further described with reference to the examples described herein; however, it is to be understood that the invention is not limited to such examples.

EXAMPLES

The following non-limiting Examples demonstrate that genes and proteins of a $CO_2$ signaling pathway and subtilisin-like serine endopeptidase-like protein such as ATSBT5.2 or homologous or orthologous genes can modulate stomatal density, stomatal index and/or stomatal size, including in combination with genes and proteins involved in stomatal movement modulation such as $CO_2$ sensor genes or OST1, SnRK2.2 or SnRK2.3.

Unless stated otherwise in the Examples, all recombinant DNA techniques are carried out according to standard protocols as described in Sambrook et al. (1989) Molecular Cloning: A Laboratory Manual, Second Edition, Cold Spring Harbor Laboratory Press, NY and in Volumes 1 and 2 of Ausubel et al. (1994) Current Protocols in Molecular Biology, Current Protocols, USA. Standard materials and methods for plant molecular work are described in Plant Molecular Biology Labfax (1993) by R. D. D. Croy, jointly published by BIOS Scientific Publications Ltd (UK) and Blackwell Scientific Publications, UK. Other references for standard molecular biology techniques include Sambrook and Russell (2001) Molecular Cloning: A Laboratory Manual, Third Edition, Cold Spring Harbor Laboratory Press, NY, Volumes I and II of Brown (1998) Molecular Biology LabFax, Second Edition, Academic Press (UK). Standard materials and methods for polymerase chain reactions can be found in Dieffenbach and Dveksler (1995) PCR Primer: A Laboratory Manual, Cold Spring Harbor Laboratory Press, and in McPherson at al. (2000) PCR—Basics: From Background to Bench, First Edition, Springer Verlag, Germany.

Throughout the description and Examples, reference is made to the following sequences:

SEQ ID 1: nucleotide sequence of the subtilisin-like serine endoprotease-like protein ATBSBT5.2 from *Arabidopsis thaliana*, splice variant nr 1 (TAIR AT1G20160.1)

SEQ ID No 2: amino acid sequence of the subtilisin-like serine endoprotease-like protein ATBSBT5.2 from *Arabidopsis thaliana*, splice variant nr 1 (TAIR AT1G20160.1)

SEQ ID No 3: nucleotide sequence of the subtilisin-like serine endoprotease-like protein ATBSBT5.2 from *Arabidopsis thaliana*, splice variant nr 2 (TAIR AT1 G20160.2)

SEQ ID No 4: amino sequence of the subtilisin-like serine endoprotease-like protein ATSBT5.2 from *Arabidopsis thaliana*, splice variant nr 2 (TAIR AT1G20160.2)

SEQ ID No 5: amino acid sequence of a subtilisin-like protease from *Triticum aestivum* having significant sequence identity to ATSBT5.2 (CAJ75644.1) SEQ ID No 6: amino acid sequence of a subtilisin-like protease from *Triticum aestivum* having significant sequence identity to ATSBT5.2 (ACB87529.1).

SEQ ID No 7: amino acid sequence of a subtilisin-like protease from *Triticum aestivum* having significant sequence identity to ATSBT5.2 (CAJ19363.1)

SEQ ID No 8: amino acid sequence of a subtilisin-like protease from *Brachypodium distachyon* having significant sequence identity to ATSBT5.2 (XP_003559397.1)

SEQ ID No 9: amino acid sequence of a subtilisin-like protease from *Brachypodium distachyon* having significant sequence identity to ATSBT5.2 (XP_003567246.1) SEQ ID No 10: amino acid sequence of a subtilisin-like protease from *Brachypodium distachyon* having significant sequence identity to ATSBT5.2 (XP_003578494.1).

SEQ ID No 11: amino acid sequence of a subtilisin-like protease from *Brachypodium distachyon* having significant sequence identity to ATSBT5.2 (XP_003569718.1)

SEQ ID No 12: amino acid sequence of a subtilisin-like protease from *Brachypodium distachyon* having significant sequence identity to ATSBT5.2 (XP_003571078.1)

SEQ ID No 13: amino acid sequence of a subtilisin-like protease from *Brachypodium distachyon* having significant sequence identity to ATSBT5.2 (XP_003559080.1)

SEQ ID No 14: amino acid sequence of a subtilisin-like protease from *Brachypodium distachyon* having significant sequence identity to ATSBT5.2 (XP_003576659.1) SEQ ID No 15: amino acid sequence of a subtilisin-like protease from *Brachypodium distachyon* having significant sequence identity to ATSBT5.2 (XP_003558354.1)

SEQ ID No 16: amino acid sequence of a subtilisin-like protease from *Brachypodium distachyon* having significant sequence identity to ATSBT5.2 (XP_003581547.1)

SEQ ID No 17: amino acid sequence of a subtilisin-like protease from *Zea mays* having significant sequence identity to ATSBT5.2 (NP_001145938.1)

SEQ ID No 18: amino acid sequence of a subtilisin-like protease from *Zea mays* having significant sequence identity to ATSBT5.2 (NP_001159267.1)

SEQ ID No 19: amino acid sequence of a subtilisin-like protease from *Zea mays* having significant sequence identity to ATSBT5.2 (NP_001169390.1)

SEQ ID No 20: amino acid sequence of a subtilisin-like protease from *Zea mays* having significant sequence identity to ATSBT5.2 (ACN27710.1)

SEQ ID No 21: amino acid sequence of a subtilisin-like protease from *Zea mays* having significant sequence identity to ATSBT5.2 (NP_001151755.1)

SEQ ID No 22: amino acid sequence of a subtilisin-like protease from *Oryza sativa* having significant sequence identity to ATSBT5.2 (EAZ09528.1)

SEQ ID No 23: amino acid sequence of a subtilisin-like protease from *Oryza sativa* having significant sequence identity to ATSBT5.2 (EAY73513.1).

SEQ ID No 24: amino acid sequence of a subtilisin-like protease from *Oryza sativa* having significant sequence identity to ATSBT5.2 (BAA89562.1)

SEQ ID No 25 amino acid sequence of a subtilisin-like protease from *Oryza sativa* having significant sequence identity to ATSBT5.2 (NP_001063751.1) SEQ ID No 26: amino acid sequence of a subtilisin-like protease from *Oryza sativa* having significant sequence identity to ATSBT5.2 (EAZ09847.1)

SEQ ID No 27: amino acid sequence of a subtilisin-like protease from *Oryza sativa* having significant sequence identity to ATSBT5.2 (NP_001175897.1)

SEQ ID No 28: amino acid sequence of a subtilisin-like protease from *Oryza sativa* having significant sequence identity to ATSBT5.2 (EAY84890.1)

SEQ ID No 29: amino acid sequence of a subtilisin-like protease from *Oryza sativa* having significant sequence identity to ATSBT5.2 (NP_001046210.1)

SEQ ID No 30: amino acid sequence of a subtilisin-like protease from *Oryza sativa* having significant sequence identity to ATSBT5.2 (EEE69917.1)

SEQ ID No 31: amino acid sequence of a subtilisin-like protease from *Oryza sativa* having significant sequence identity to ATSBT5.2 (EEC71416.1)

SEQ ID No 32: amino acid sequence of a subtilisin-like protease from *Oryza sativa* having significant sequence identity to ATSBT5.2 (BAB21149.1)

SEQ ID No 33: amino acid sequence of a subtilisin-like protease from *Oryza sativa* having significant sequence identity to ATSBT5.2 (NP_001050634.1)

SEQ ID No 34 amino acid sequence of a subtilisin-like protease from *Oryza sativa* having significant sequence identity to ATSBT5.2 (EAZ01729.1)

SEQ ID No 35: amino acid sequence of a subtilisin-like protease from *Oryza sativa* having significant sequence identity to ATSBT5.2 (NP_001174909.1)

SEQ ID No 36: amino acid sequence of a subtilisin-like protease from *Oryza sativa* having significant sequence identity to ATSBT5.2 (NP_001051353.1)

SEQ ID No 37: amino acid sequence of a subtilisin-like protease from *Oryza sativa* having significant sequence identity to ATSBT5.2 (BAC22315.1)

SEQ ID No 38: amino acid sequence of a subtilisin-like protease from *Oryza sativa* having significant sequence identity to ATSBT5.2 (NP_001049524.2)

SEQ ID No 39: amino acid sequence of a subtilisin-like protease from *Oryza sativa* having significant sequence identity to ATSBT5.2 (NP_001053614.1)

SEQ ID No 40: amino acid sequence of a subtilisin-like protease from *Solanum esculentum* having significant sequence identity to ATSBT5.2 (NP_001234282.1)

SEQ ID No 41: amino acid sequence of a subtilisin-like protease from *Solanum esculentum* having significant sequence identity to ATSBT5.2 (NP_001234288.1)

SEQ ID No 42: amino acid sequence of a subtilisin-like protease from *Solanum esculentum* having significant sequence identity to ATSBT5.2 (NP_001233982.1)

SEQ ID No 43: amino acid sequence of a subtilisin-like protease from *Solanum esculentum* having significant sequence identity to ATSBT5.2 (CAB67119.1)

SEQ ID No 44: amino acid sequence of a subtilisin-like protease from *Solanum esculentum* having significant sequence identity to ATSBT5.2 (CAB67120.1)

SEQ ID No 45: amino acid sequence of a subtilisin-like protease from *Solanum esculentum* having significant sequence identity to ATSBT5.2 (CAA76727.1)

SEQ ID No 46: amino acid sequence of a subtilisin-like protease from *Solanum esculentum* having significant sequence identity to ATSBT5.2 (CAA06412.1)

SEQ ID No 47: amino acid sequence of a subtilisin-like protease from *Solanum esculentum* having significant sequence identity to ATSBT5.2 (CAA06414.1)

SEQ ID No 48: amino acid sequence of a subtilisin-like protease from *Solanum esculentum* having significant sequence identity to ATSBT5.2 (CAA07250.1)

SEQ ID No 49: amino acid sequence of a subtilisin-like protease from *Solanum esculentum* having significant sequence identity to ATSBT5.2 (CAA06413.1)

SEQ ID No 50: amino acid sequence of a subtilisin-like protease from *Solanum esculentum* having significant sequence identity to ATSBT5.2 (NP_001234257.1)

SEQ ID No 51: amino acid sequence of a subtilisin-like protease from *Solanum esculentum* having significant sequence identity to ATSBT5.2 (CAA07059.1)

SEQ ID No 52: amino acid sequence of a subtilisin-like protease from *Solanum esculentum* having significant sequence identity to ATSBT5.2 (CAA76726.1)

SEQ ID No 53: amino acid sequence of a subtilisin-like protease from *Glycine max* having significant sequence identity to ATSBT5.2 (XP_003523384.1)

SEQ ID No 54: amino acid sequence of a subtilisin-like protease from *Glycine max* having significant sequence identity to ATSBT5.2 (NP_001236511.1)

SEQ ID No 55: amino acid sequence of a subtilisin-like protease from *Glycine max* having significant sequence identity to ATSBT5.2 (AAK53589.1)

SEQ ID No 56: amino acid sequence of a subtilisin-like protease from *Glycine max* having significant sequence identity to ATSBT5.2 (XP_003523395.1)

SEQ ID No 57: amino acid sequence of a subtilisin-like protease from *Glycine max* having significant sequence identity to ATSBT5.2 (NP_001238252.1) SEQ ID No 58: amino acid sequence of a subtilisin-like protease from *Glycine max* having significant sequence identity to ATSBT5.2 (XP_003541562.1)

SEQ ID No 59: amino acid sequence of a subtilisin-like protease from *Glycine max* having significant sequence identity to ATSBT5.2 (XP_003545787.1)

SEQ ID No 60: amino acid sequence of a subtilisin-like protease from *Glycine max* having significant sequence identity to ATSBT5.2 (XP_003537841.1)

SEQ ID No 61: amino acid sequence of a subtilisin-like protease from *Glycine max* having significant sequence identity to ATSBT5.2 (XP_003524182.1)

SEQ ID No 62: amino acid sequence of a subtilisin-like protease from *Glycine max* having significant sequence identity to ATSBT5.2 (XP_003534221.1)

SEQ ID No 63: amino acid sequence of a subtilisin-like protease from *Glycine max* having significant sequence identity to ATSBT5.2 (XP_003547892.1)

SEQ ID No 64: amino acid sequence of a subtilisin-like protease from *Glycine max* having significant sequence identity to ATSBT5.2 (XP_003539821.1)

SEQ ID No 65: amino acid sequence of a subtilisin-like protease from *Glycine max* having significant sequence identity to ATSBT5.2 (XP_003538129.1)

SEQ ID No 66: amino acid sequence of a subtilisin-like protease from *Glycine max* having significant sequence identity to ATSBT5.2 (XP_003538919.1)

SEQ ID No 67: amino acid sequence of a subtilisin-like protease from *Glycine max* having significant sequence identity to ATSBT5.2 (XP_003516513.1)

SEQ ID No 68: amino acid sequence of a subtilisin-like protease from *Glycine max* having significant sequence identity to ATSBT5.2 (XP_003540860.1)

SEQ ID No 69: amino acid sequence of a subtilisin-like protease from *Glycine max* having significant sequence identity to ATSBT5.2 (XP_003538985.1)

SEQ ID No 70: amino acid sequence of a subtilisin-like protease from *Glycine max* having significant sequence identity to ATSBT5.2 (XP_003523991.1)

SEQ ID No 71: amino acid sequence of a subtilisin-like protease from *Glycine max* having significant sequence identity to ATSBT5.2 (XP_003538797.1)

SEQ ID No 72: amino acid sequence of a subtilisin-like protease from *Glycine max* having significant sequence identity to ATSBT5.2 (XP_003523496.1)

SEQ ID NO:73: nucleotide sequence of β carbonic anhydrase 4 (CA4) from *Arabidopsis thaliana* (At1g70410)

SEQ ID NO:74: nucleotide sequence of f3 carbonic anhydrase 4 (CA4) from *Arabidopsis thaliana*—coding sequence.

SEQ ID NO:75: amino acid sequence of β carbonic anhydrase 4 (CA4) from *Arabidopsis thaliana*.

SEQ ID NO:76: nucleotide sequence of β carbonic anhydrase 6 (CA6) from *Arabidopsis thaliana* (At1g58180)

SEQ ID NO:77: nucleotide sequence of β carbonic anhydrase 6 (CA6) from *Arabidopsis thaliana*—coding sequence.

SEQ ID NO:78: amino acid sequence of β carbonic anhydrase 6 (CA6) from *Arabidopsis thaliana*.

SEQ ID NO:79: nucleotide sequence of f3 carbonic anhydrase 1 (CA1) from *Arabidopsis thaliana*—variant 1

SEQ ID NO:80: amino acid sequence of β carbonic anhydrase 1 (CA1) from *Arabidopsis thaliana*—variant 1

SEQ ID NO:81: nucleotide sequence of β carbonic anhydrase 1 (CA1) from *Arabidopsis thaliana*—variant 2

SEQ ID NO:82: amino acid sequence of β carbonic anhydrase 1 (CA1) from *Arabidopsis thaliana*—variant 2

SEQ ID NO:83: nucleotide sequence of OST1 protein kinase cDNA from *Arabidopsis thaliana*—variant 1

SEQ ID NO:84: amino acid sequence of OST1 protein kinase cDNA from *Arabidopsis thaliana*—variant 1

SEQ ID NO:85: nucleotide sequence of OST1 protein kinase cDNA from *Arabidopsis thaliana*—variant 2

SEQ ID NO:86: amino acid sequence of OST1 protein kinase cDNA from *Arabidopsis thaliana*—variant 2

SEQ ID NO:87: nucleotide sequence of *A. thaliana* β carbonic anhydrase 2 (CA2) cDNA (At5g14740)

SEQ ID NO:88: amino acid sequence of *A. thaliana* β carbonic anhydrase 2 (CA2) (At5g14740)

SEQ ID NO:89: nucleotide sequence of *A. thaliana* α carbonic anhydrase 1 (CA1) cDNA (At3g52720)

SEQ ID NO:90: amino acid sequence of *A. thaliana* α carbonic anhydrase 1 (CA1) (At3g52720)

SEQ ID NO:91: nucleotide sequence of *A. thaliana* α carbonic anhydrase 2 (CA2) cDNA (At2g28210)

SEQ ID NO:92: amino acid sequence of *A. thaliana* α carbonic anhydrase 2 (CA2) (At2g28210)

SEQ ID NO:93: nucleotide sequence of *A. thaliana* α carbonic anhydrase 3 (CA3) cDNA (At5g04180)

SEQ ID NO:94: amino acid sequence of *A. thaliana* α carbonic anhydrase 3 (CA3) (At5g04180)

SEQ ID NO:95: nucleotide sequence of *A. thaliana* α carbonic anhydrase 4 (CA4) cDNA (At4g20990)

SEQ ID NO:96: amino acid sequence of *A. thaliana* α carbonic anhydrase 4 (CA4) (At4g20990)

SEQ ID NO:97: nucleotide sequence of *A. thaliana* α carbonic anhydrase 5 (CA5) cDNA (At1g08065)

SEQ ID NO:98: amino acid sequence of *A. thaliana* α carbonic anhydrase 5 (CA5) (At 1 g08065)

SEQ ID NO:99: nucleotide sequence of *A. thaliana* α carbonic anhydrase 6 (CA6) cDNA (At4g21000)

SEQ ID NO:100: amino acid sequence of *A. thaliana* α carbonic anhydrase 6 (CA6) (At4g21000)

SEQ ID NO:101: nucleotide sequence of *A. thaliana* α carbonic anhydrase 7 (CA7) cDNA (At1g08080)

SEQ ID NO:102: amino acid sequence of *A. thaliana* α carbonic anhydrase 7 (CA7) (At1g08080)

SEQ ID NO:103: nucleotide sequence of *A. thaliana* α carbonic anhydrase 8 (CA8) cDNA (At5g56330)

SEQ ID NO:104: amino acid sequence of *A. thaliana* α carbonic anhydrase 8 (CA8) (At5g56330)

SEQ ID NO:105: nucleotide sequence of *A. thaliana* β carbonic anhydrase 3 (CA3) cDNA (At1g23730)
SEQ ID NO:106: amino acid sequence of *A. thaliana* β carbonic anhydrase 3 (CA3) cDNA (At1g23730)
SEQ ID NO:107: nucleotide sequence of *A. thaliana* β carbonic anhydrase 5 (CA5) cDNA (At4g33580)
SEQ ID NO:108: amino acid sequence of *A. thaliana* β carbonic anhydrase 5 (CA5) cDNA (At4g33580)
SEQ ID NO:109: nucleotide sequence of *A. thaliana* γ carbonic anhydrase 1 (CA1) cDNA (At 1 g19580)
SEQ ID NO:110: amino acid sequence of *A. thaliana* γ carbonic anhydrase 1 (CA1) cDNA (At1g19580)
SEQ ID NO:111: nucleotide sequence of *A. thaliana* γ carbonic anhydrase 2 (CA2) cDNA (At1g47260)
SEQ ID NO:112: amino acid sequence of *A. thaliana* γ carbonic anhydrase 2 (CA2) (At1g47260)
SEQ ID NO:113: nucleotide sequence of *A. thaliana* γ carbonic anhydrase 3 (CA3) cDNA (At5g66510)
SEQ ID NO:114: amino acid sequence of *A. thaliana* γ carbonic anhydrase 3 (CA3) (At5g66510)
SEQ ID NO:115: nucleotide sequence of *A. thaliana* γ carbonic anhydrase like 1 (CAL1) cDNA (At5g63510)
SEQ ID NO:116: amino acid sequence of *A. thaliana* γ carbonic anhydrase like 1 (CAL 1) (At5g63510)
SEQ ID NO:117: nucleotide sequence of *A. thaliana* γ carbonic anhydrase 2 (CAL2) cDNA (At3g48680)
SEQ ID NO:118: amino acid sequence of *A. thaliana* γ carbonic anhydrase 2 (CAL2) (At3g48680)
SEQ ID NO.119: amino acid sequence of STOMAGEN
SEQ ID NO. 120: amino acid sequence of EPF2-Long
SEQ ID NO. 121: amino acid sequence of EPF1
SEQ ID NO. 122: amino acid sequence of EPF2.

Example 1: $CO_2$ Regulation of Stomatal Development by Carbonic Anhydrases

This example presents data demonstrating or establishing inter alia that ca1ca4 mutants are impaired in their ability to regulate stomatal conductance and closing in response to shifts in atmospheric $CO_2$ concentrations; that ca1ca4 leaf epidermes show an increased stomatal density, stomatal index and/or stomatal size, and stomatal index phenotype, compared to wildtype leaf epidermes; that known components of the stomatal development pathway mediate the increased stomatal density; that carbonic anhydrase enzyme activity is crucial for the stomatal density phenotype; and, that increased stomatal density of the ca1ca4 mutant results in a cooler (compared to wild type) leaf temperature, and that increased rates of evapo-transpiration in the ca1ca4 mutant plants results in decreased leaf temperatures compared to wild type leaves.

How signals are perceived and transduced during the regulation of stomatal development by atmospheric carbon dioxide ($CO_2$) levels is not known. Currently one mutant, hic[1], has been demonstrated to show a de-regulation of $CO_2$-controlled stomatal development. We have isolated *Arabidopsis thaliana* carbonic anhydrase mutants which show an impaired stomatal movement response to shifts in atmospheric $CO_2$ levels[2]. These plants exhibit, relative to wild type plants, a disruption of $CO_2$ control of stomatal development. We investigated the molecular and genetic mechanisms mediating $CO_2$-regulated stomatal development in these mutants. We used cell lineage-specific markers, confocal microscopy and mutants in the $CO_2$ signaling machinery, to characterize the $CO_2$-controlled stomatal development phenotype in *Arabidopsis*. Complementation studies with heterologous carbonic anhydrase expression in our mutants indicate that $CO_2$ control of stomatal development functions via cell-cell signaling mechanisms and occurs during a defined phase of stomatal cell lineage specification. We conducted $CO_2$-dependent systems experiments in an attempt to capture cell-cell signaling candidates.

Carbonic Anhydrases Control $CO_2$ Regulation of Gas Exchange

Figure 8:
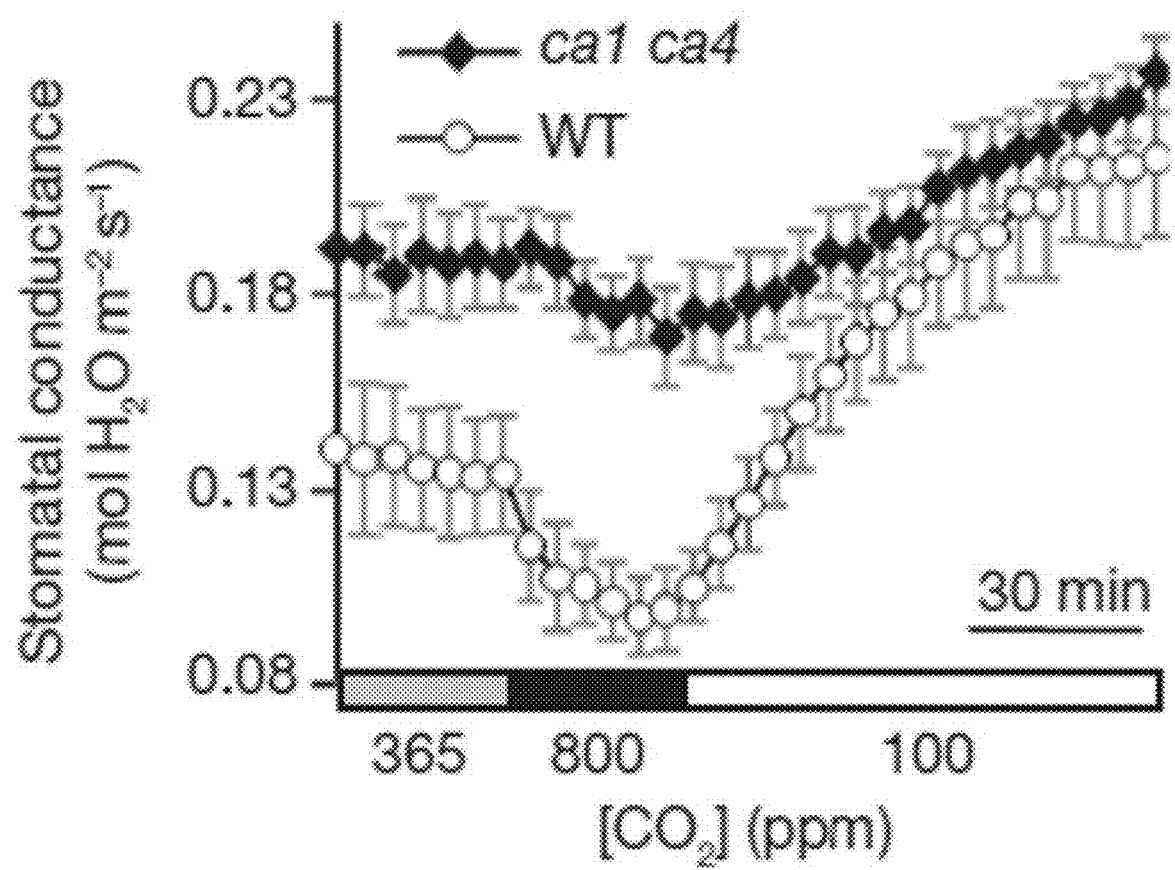
FIG. 8: Graphically illustrates time-resolved stomatal conductance responses to $CO_2$ shifts (365→800→100 ppm) in wildtype (WT) and ca1ca4 mutant plants. Measurements were conducted using a Li-6400 infrared (IRGA)-based gas exchange analyzer system with a fluorometer chamber (Li-Cor Inc.).
Figure 9:
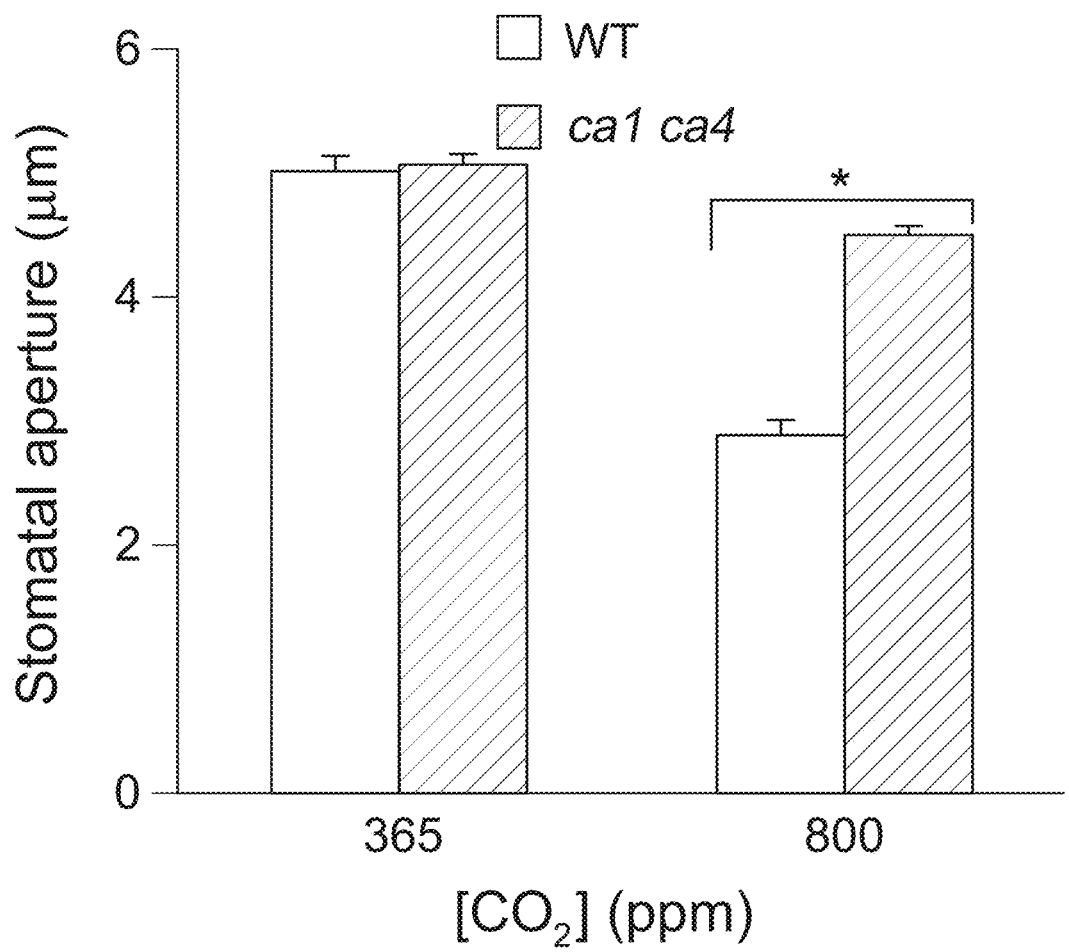
FIG. 9: Graphically illustrates data showing that high $CO_2$-induced stomatal closing is impaired in ca1ca4 mutant leaf epidermes. Leaf epidermes were treated with 800 ppm $CO_2$ for 30 min.

Plants respond to changes in the levels of atmospheric $CO_2$ Specifically, stomata, which are pores on the epidermes of aerial plant structures, exhibit a short term response to high levels of $CO_2$ by mediating stomatal closing (see WT in FIGS. 8 and 9). However, little is known about the early signaling mechanism(s) following the initial $CO_2$ perception in plants. We have previously reported on the $CO_2$ stomatal response of *Arabidopsis* plants bearing mutations in the beta carbonic anhydrase genes Ca1 and Ca4 (Hu et al., 2010). The ca1ca4 mutants are impaired in their ability to regulate stomatal conductance and closing in response to shifts in atmospheric $CO_2$ concentrations. This de-regulation is seen at the intact leaf level as well as at the individual stomate level, as illustrated in FIGS. 8 and 9 (see ca1ca4 in FIGS. 8 and 9).

Stomatal Density is Also Controlled by Carbonic Anhydrase Genes

Figure 10A:
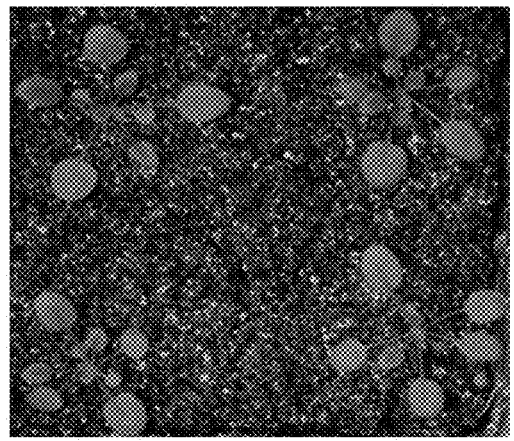
FIG. 10: A, Graphically illustrates photographs of wild type and ca1ca4 plants grown in parallel. B, Confocal images of abaxial epidermes of wild type and ca1ca4 plants. C, Graphically illustrates abaxial stomatal densities for wild type and ca1ca4 plants.
Figure 10B:
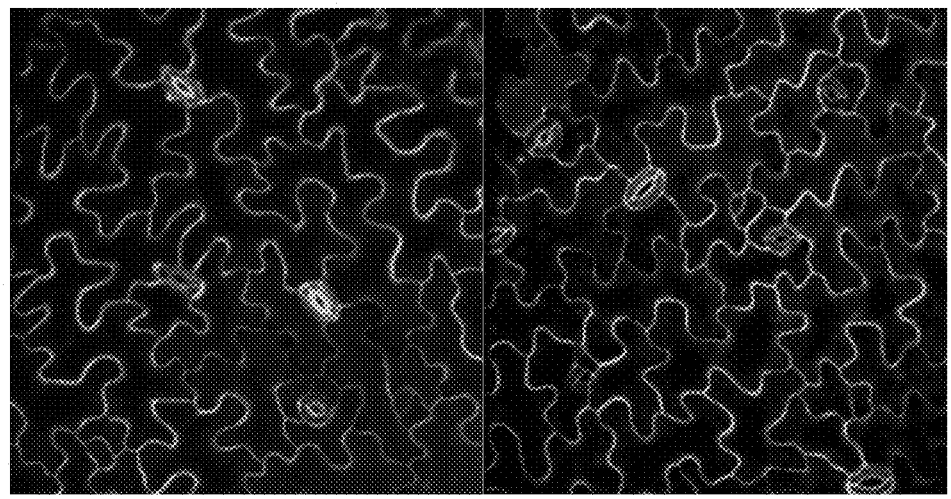
Figure 10C:
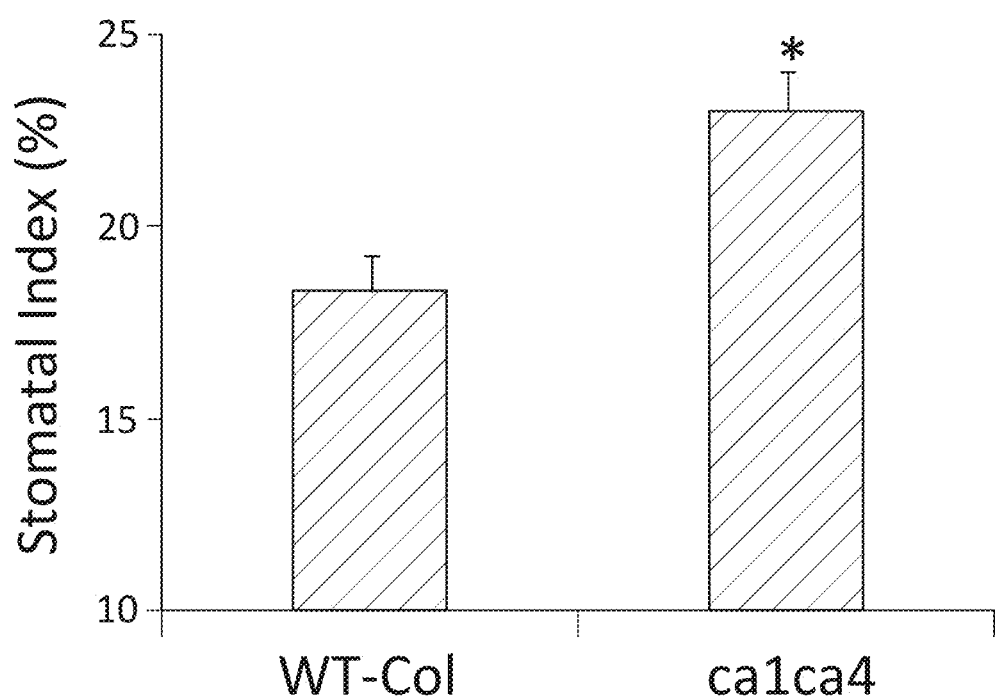

The ca1ca4 mutant plants show no gross phenotypic or growth differences when compared with wild type plants (FIG. 10A). Flowering time and seed viability in these plants is also similar to wild type. The pavement cells in the mutant leaf epidermes are similar in size and shape to those of the wild type. Similar to wild type, stomata in the epidermes of the mutant exhibit a minimum of a single (pavement) cell spacing between neighboring stomates (FIG. 10B). Interestingly, the ca1ca4 leaf epidermes show an increased stomatal density and stomatal index phenotype compared to wildtype leaf epidermes (FIG. 10C).

Figure 11A:
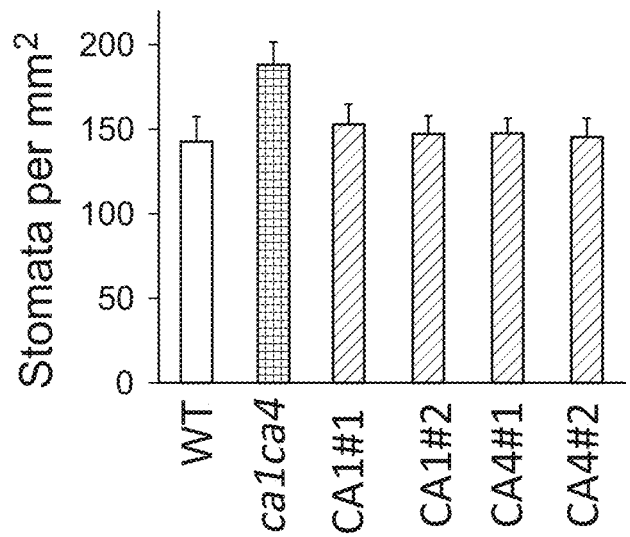
FIG. 11: Graphically illustrates data showing complementation of the stomatal density phenotype of ca1ca4 plants. A, Stomatal density measurements for abaxial leaf epidermes of wt, ca1ca4, and 2 independent lines for the ca1ca4 mutant complemented with genomic fragments of either AtCa1 or AtCa4. B, Stomatal density measurements for abaxial leaf epidermes of wt, ca1ca4, and 2 independent lines for the ca1ca4 mutant complemented with over-expression constructs for either AtCa1 or AtCa4.
Figure 11B:
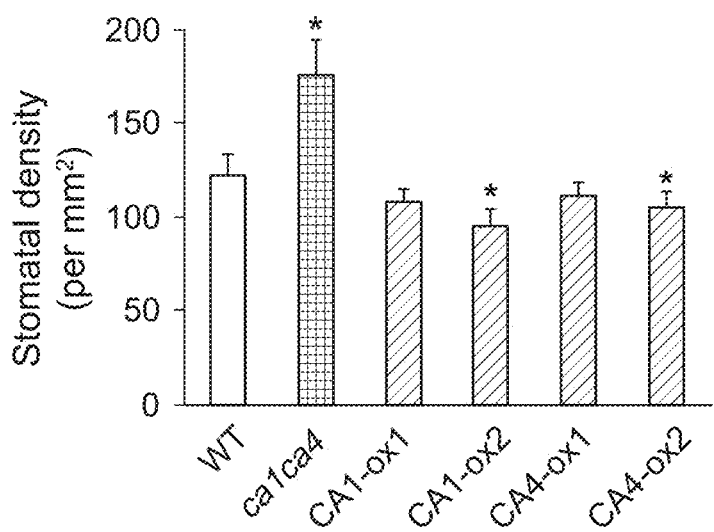

Genomic Complementation and Over-Expression with Either AtCA1 or AtCA4 Restores the Mutant Stomatal Density Phenotype Complementation with genomic copies of either AtCa1 or AtCa4 restores the stomatal density and index phenotypes to wild type levels (Hu et al., 2010; FIG. 11A). Complementation studies with cDNAs of AtCa1 or AtCa4 also independently complement the mutant phenotype (data not shown). Furthermore, over-expression of these genes reduced the stomatal density of the mutants to slightly lower than wild type (Hu et al., 2010; FIG. 11B), further pointing to a role for these carbonic anhydrases in the modulation of stomatal development.

Figure 12A:
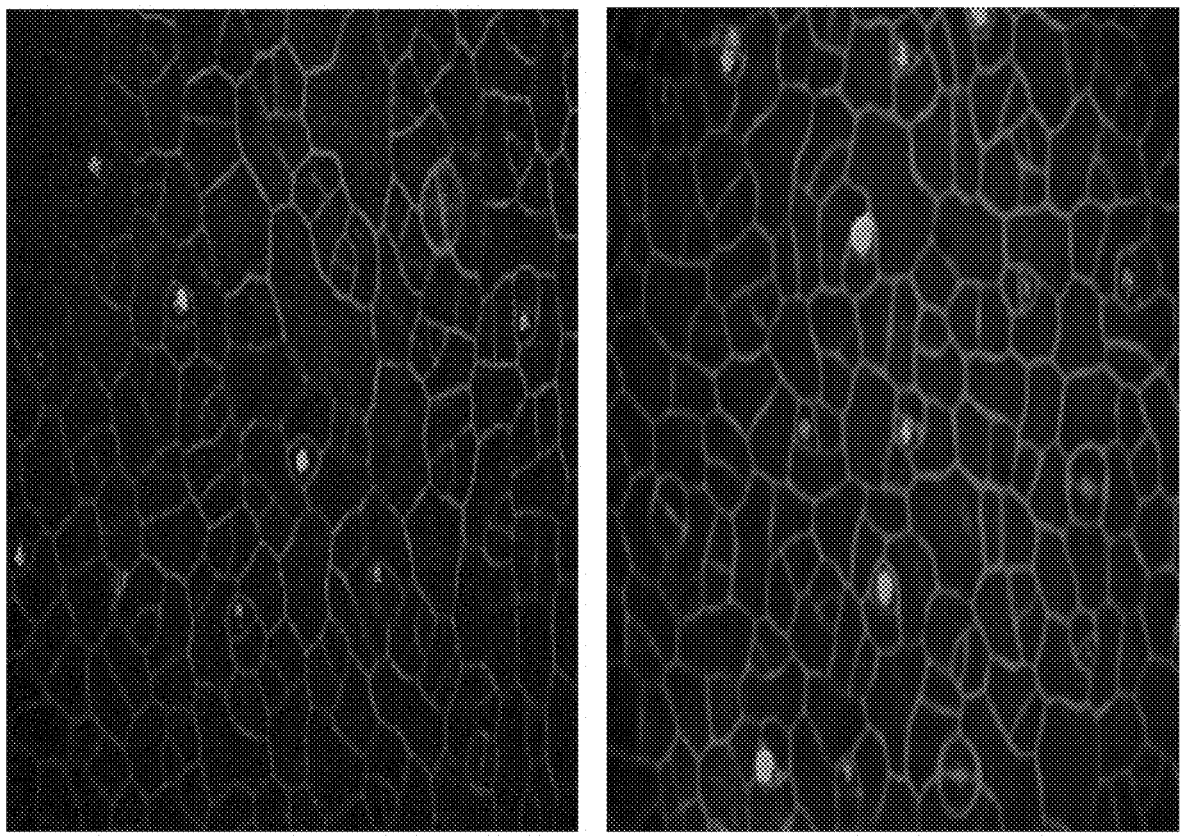
FIG. 12: MUTE expression in wild type and ca1ca4 plants. A, Confocal overlay images of GFP and Propidium iodide stained abaxial epidermes of wt and ca1ca4 plants. B, Graphically illustrates quantitation of MUTE-GFP expressing cells per unit area in abaxial epidermes of wt and ca1ca4 plants.
Figure 12B:
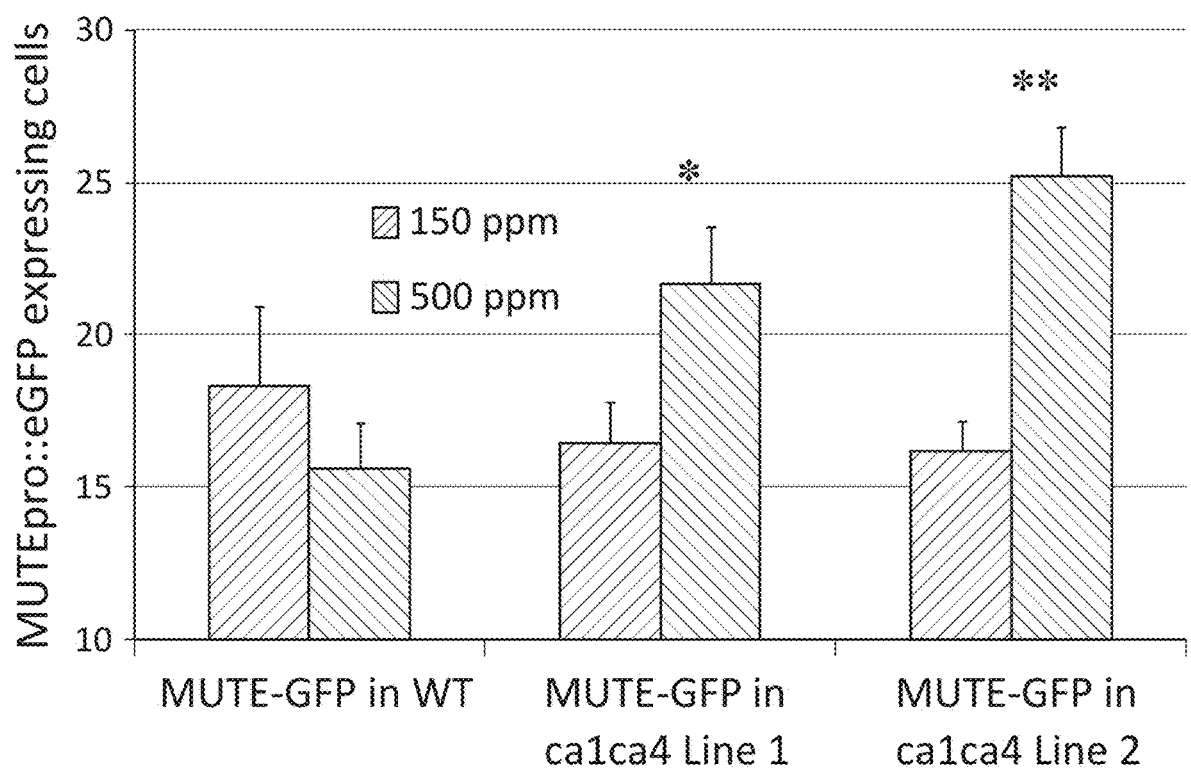
Figure 13:
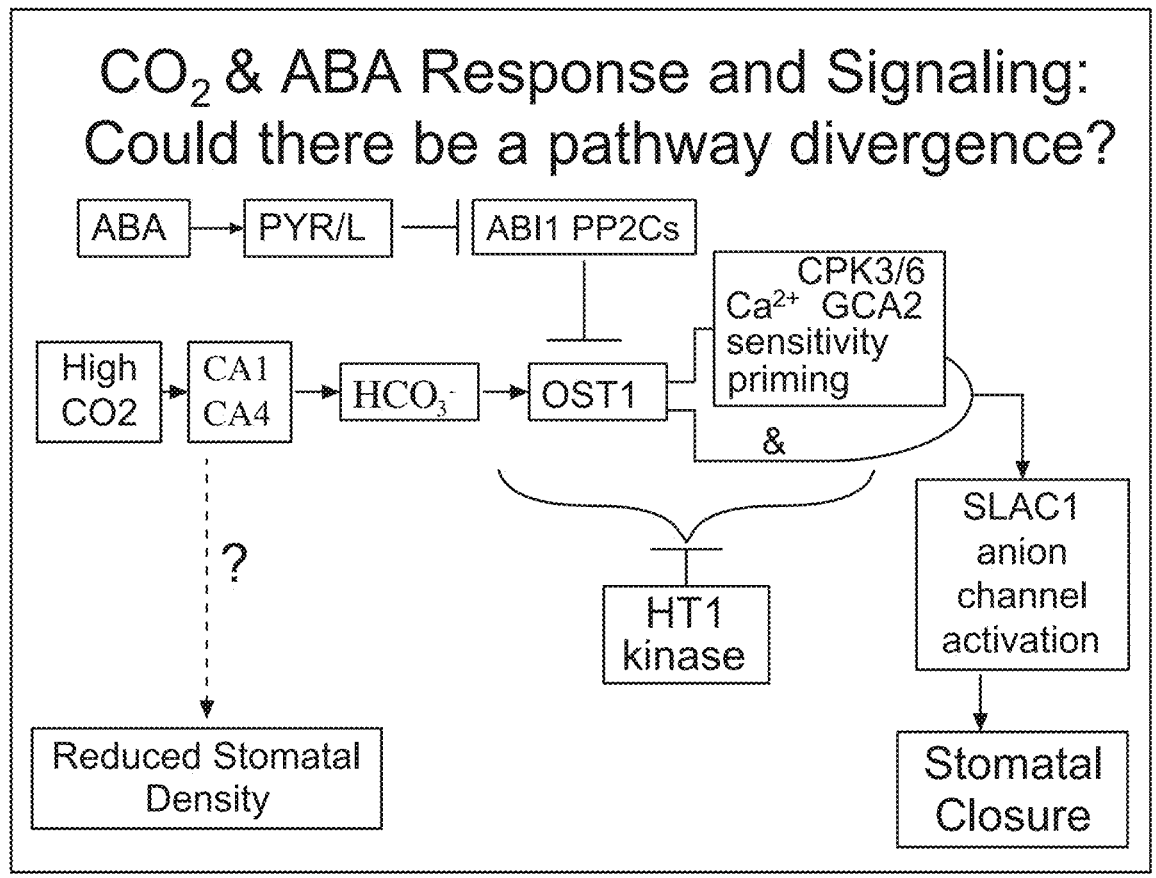
FIG. 13: Schematically illustrates carbon dioxide ($CO_2$) and ABA response and signaling pathways which lead to stomatal closure and reduced stomatal density.
Figure 14:
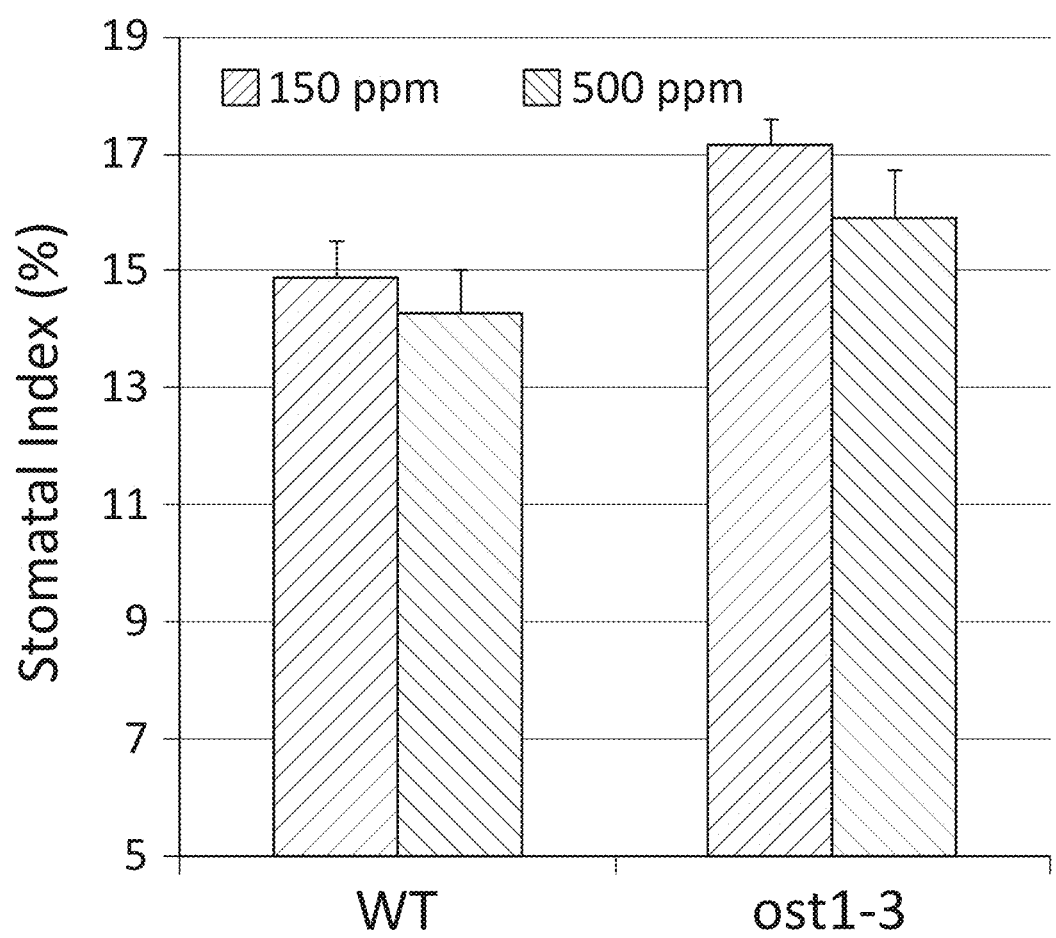
FIG. 14: Graphically illustrates data showing that $CO_2$ control of stomatal development is intact in the ost1-3 mutant.
Figure 15:
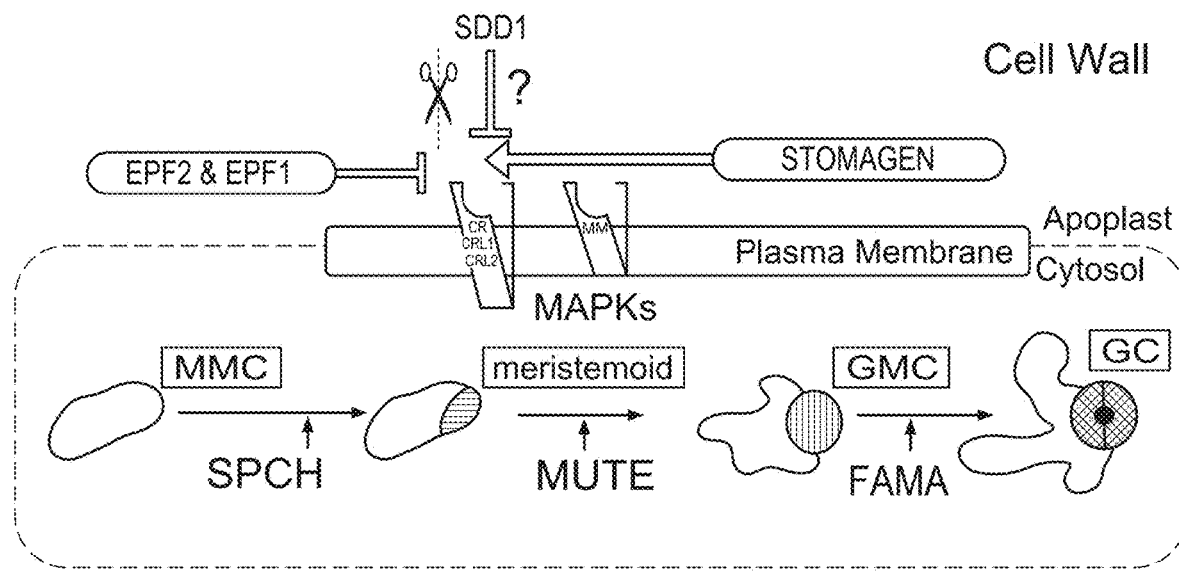
FIG. 15: Schematically illustrates the cellular pathways, or cell machinery, regulating stomatal cell fate.
Figure 16A:
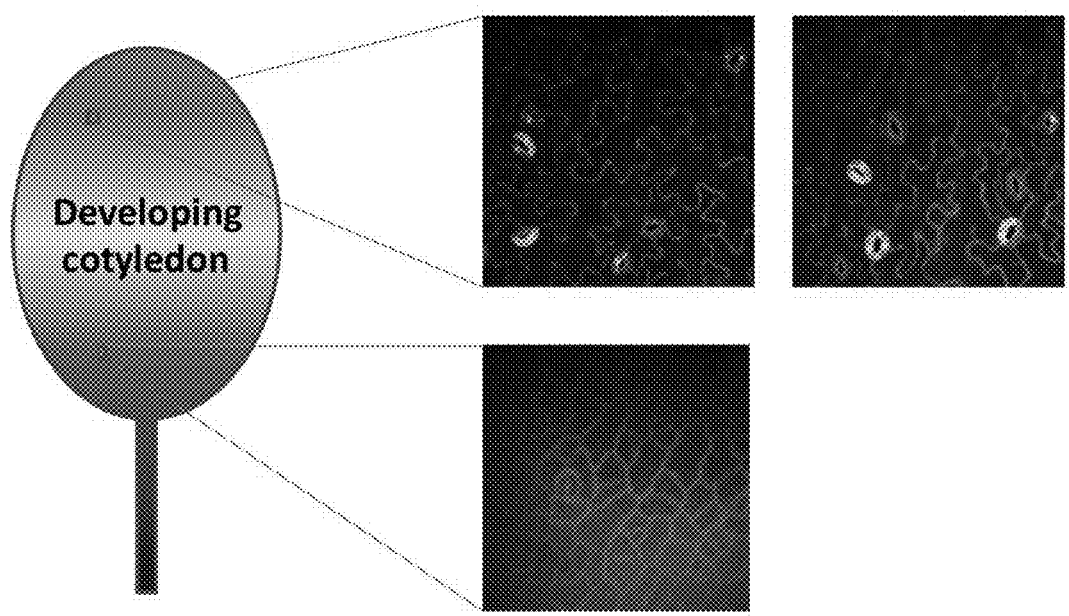
FIG. 16: Illustrates picture of (FIG. 16A) and graphically (FIG. 16B) illustrates complementation of the ca1ca4 mutant stomatal density phenotype when transformed with an unrelated human alpha carbonic anhydrase (CA II). Three independent T-DNA lines (H1, H2 and H3) show suppression of the high stomatal density phenotype seen in the ca1ca4 mutant, which was used as the background for transformation.
Figure 16B:
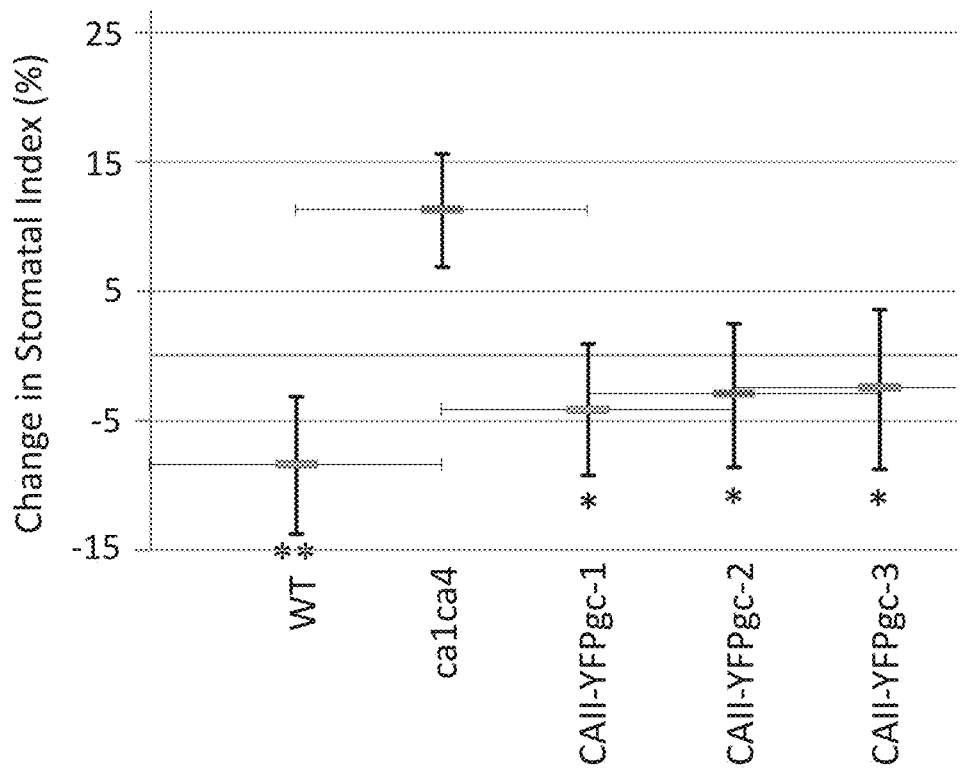

MUTE Expression in Developing Leaves Correlates with Stomatal Density Phenotype of Mutant Next, we wanted to establish if known components of the stomatal developmental pathway (Bergmann and Sack, 2007) were involved in the increased stomatal density in the ca1ca4 mutant. We chose MUTEpro::nucGFP (MacAlister et al., 2007; Pillitteri et al., 2008) marker expression as an indicator to inform us whether the increased stomatal density in our mutant was being mediated by members of the known stomatal development pathway. Increased numbers of MUTE expressing cells correlate with our ca1ca4 mutant stomatal density phenotype (FIGS. 12A and 12B). Hence the known components of the stomatal development pathway mediate the increased stomatal density.

Is Carbonic Anhydrase Structure or Activity Important for Modulation of Stomatal Density?

Since the *Arabidopsis* beta carbonic anhydrase (CM and CA4) gene studies showed complementation of the mutant stomatal density phenotype in ca1ca4, we asked whether it was protein structure itself or enzyme activity that was necessary/sufficient for complementation. To address this question, we chose to include an unrelated alpha carbonic anhydrase with low sequence identity to the *Arabidopsis* CA1 and CA4 genes in our complementation studies. We generated complementation lines expressing this distant carbonic anhydrase from *Homo sapiens* (CA-II) in the ca1ca4 mutant. We tested three independent T-DNA lines, and in all three we saw complementation of the ca1ca4 stomatal density phenotype, thereby establishing that carbonic anhydrase enzyme activity is crucial for the stomatal density phenotype.

How can we Identify More Players in this Pathway? Thermal Imaging Screen

Figure 17A:
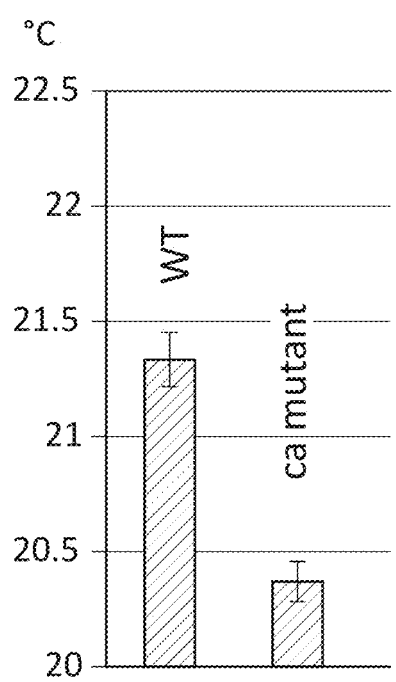
FIG. 17: Illustrates Thermal imaging and quantitation of leaf temperature. A, graphically illustrates measurements of leaf temperatures for wild type and ca1ca4 leaves using an infrared thermal camera. B, Pictorially illustrates an example of an enhancer mutant line. C, Pictorially illustrates an example of a suppressor mutant line.
Figure 17B:
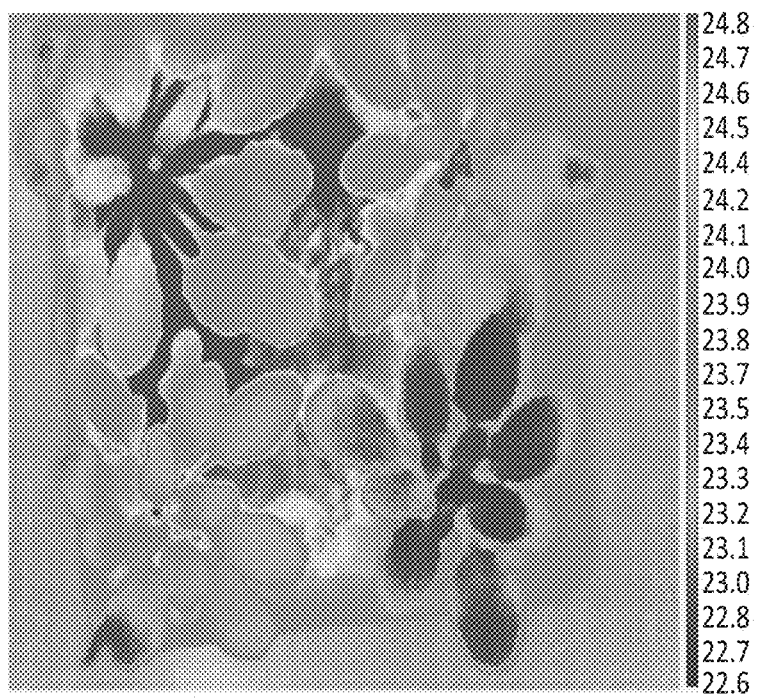
Figure 17C:
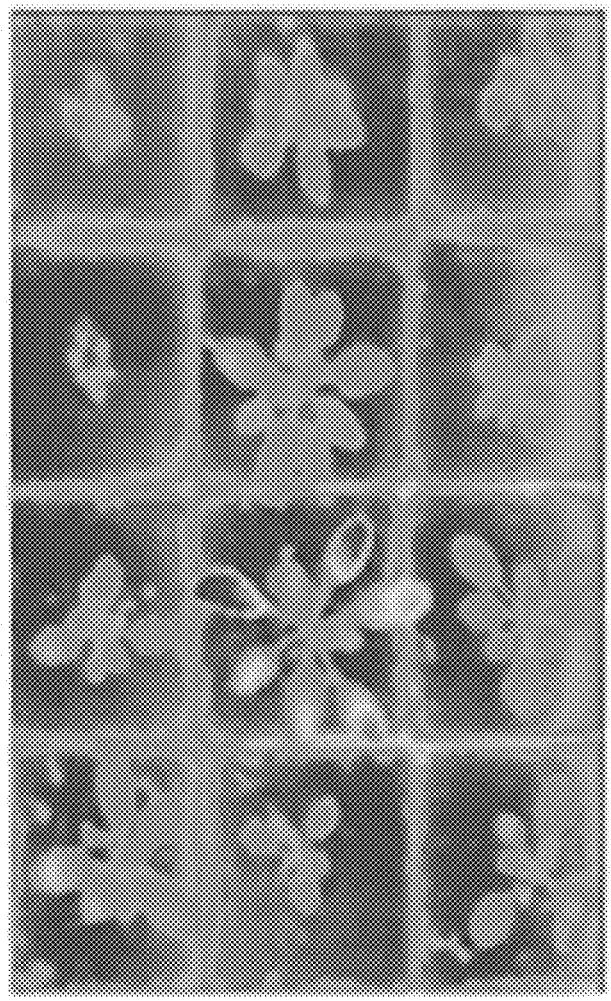

The increased stomatal density of the ca1ca4 mutant (FIG. 10C) results in a cooler (compared to wild type) leaf temperature (FIG. 17A). We demonstrated that increased rates of evapo-transpiration in the ca1ca4 mutant plants results in decreased leaf temperatures compared to wild type leaves. We have capitalized on this thermal phenotype to design a screen for enhancer and suppressor candidates (FIGS. 17B and C) of our mutant phenotype using mutagenized plant populations. We chose activation tagging as our primary mutagenesis approach and combined it with infra-red thermal imaging to conduct a high throughput screen in the ca1ca4 genetic background.

REFERENCES EXAMPLE 1

Bergmann, D. C. and F. D. Sack (2007). "Stomatal development." Annu Rev Plant Biol 58: 163-181.

Hu, H., Boisson-Dernier, A., Israelsson-Nordstrom, M., Bohmer, M., Xue, S., Ries, A., Godoski, J., Kuhn, J. M., and Schroeder, J. I. (2010). Carbonic anhydrases are upstream regulators of $CO_2$-controlled stomatal movements in guard cells. Nature Cell Biology 12, 87-93; sup pp 81-18.

MacAlister, C. A., K. Ohashi-Ito, and Bergmann, D. C. (2007). "Transcription factor control of asymmetric cell divisions that establish the stomatal lineage." Nature 445(7127): 537-540.

Pillitteri, L. J., N. L. Bogenschutz, and Torii, K. U. (2008). "The bHLH protein, MUTE, controls differentiation of stomata and the hydathode pore in *Arabidopsis*." Plant Cell Physiol 49(6): 934-943.

Example 2: Carbon Dioxide Control of Stomatal Development by Carbonic Anhydrases, EPF2 and the $CO_2$-Regulated Secreted Subtilisin-Like Serine Protease (CRSP)

Environmental stimuli, including elevated CO2, humidity and drought, regulate stomatal development[1-3] and key mechanisms mediating the perception and relay of these stimuli remain elusive. To adapt CO2 intake to water loss, plants regulate the development of stomatal gas exchange pores in the epidermis. Diverse plant species show a decrease in stomatal density in response to the continuing rise of atmospheric $CO2$[4]. To date, only one mutant, hic[5], defective in cell wall wax biosynthesis, has been identified that shows a de-regulation of this $CO_2$-controlled stomatal development response. hic mutant leaves exhibit increased stomatal density, rather than a decrease, upon $CO_2$ elevation. Here we show that recently isolated *Arabidopsis thaliana* carbonic anhydrase double mutant plants[6] exhibit an inversion in their response to elevated $CO_2$, showing increased stomatal development at elevated $CO_2$ levels. We show that this stomatal development phenotype is specifically related to defects in $CO_2$ responsiveness and signal transduction and not a consequence of altered transpiration or stomatal conductance. We have characterized the mechanisms mediating this response and provide evidence for non-cell autonomous regulation of CO2-controlled stomatal development by carbonic anhydrases. Transcriptomic RNA-Seq analyses show that the extracellular pro-peptide gene Epf2[7,8], but not Epf1, is CO2-induced and is essential for CO2 control of stomatal development.

Using cell wall proteomic and CO2-dependent RNA-Seq transcriptome analyses, we identified a novel CO2-induced extracellular protease, CRSP (CO2 Responsive Secreted Protease), as a key mediator of CO2 controlled stomatal development that can cleave EPF2 in vitro. A model for signaling of environmental cues during cell fate specification emerges from this research and our results identify a framework of mechanisms through which the continuing atmospheric CO2 elevation reduces stomatal development in leaves via non cell-autonomous carbonic anhydrase-controlled expression of the protease CRSP and the pro-peptide EPF2, thus repressing stomatal development.

CO2 exchange and water loss between plants and the atmosphere depends upon the numbers of stomata and stomatal aperture size, and plants have evolved sophisticated mechanisms to control this flux[1-3,9,11]. Ecophysiological studies have highlighted the importance of stomatal density in the context of global ecology and climate change[12]. Plants adapt to the continuing rise in atmospheric CO2 levels by reducing their stomatal density (number of stomata per epidermal surface area)[4]. Recent research efforts have led to the discovery of genes and mechanisms that function in stomatal development and patterning pathways and evidence suggests that cell-cell signaling is involved in these processes[1-3,7,8,13-20]. The only study reporting a de-regulation of the elevated CO2-mediated repression of stomatal development identified a mutant in the hic gene, which is involved in leaf wax biosynthesis and thought to alter the permeability of the guard cell extracellular matrix and consequently the diffusion of a possible extracellular signal(s) mediating stomatal development[5]. The underlying mechanisms mediating elevated $CO_2$ regulation of stomatal development have remained elusive.

Figure 1B:
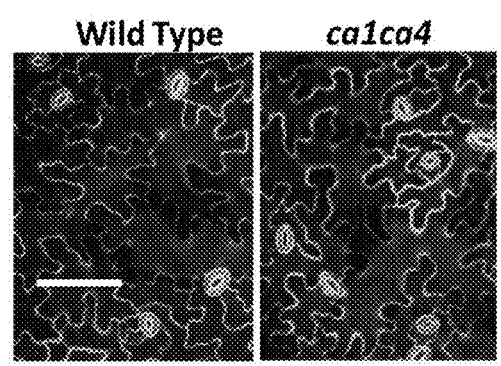
Figure 1C:
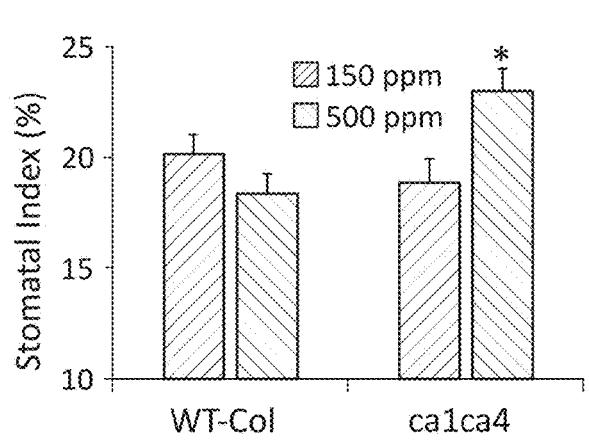
Figure 1D:
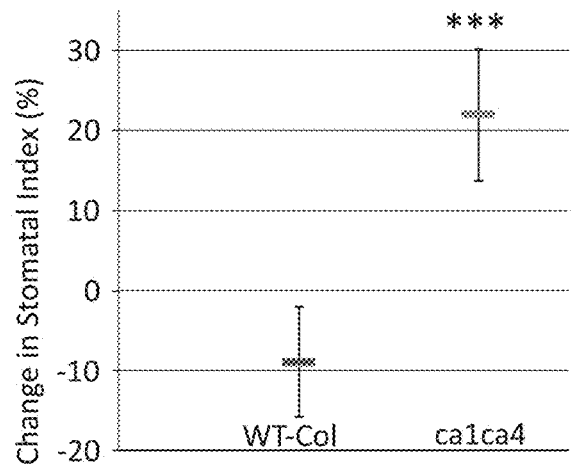
Figure 1E:
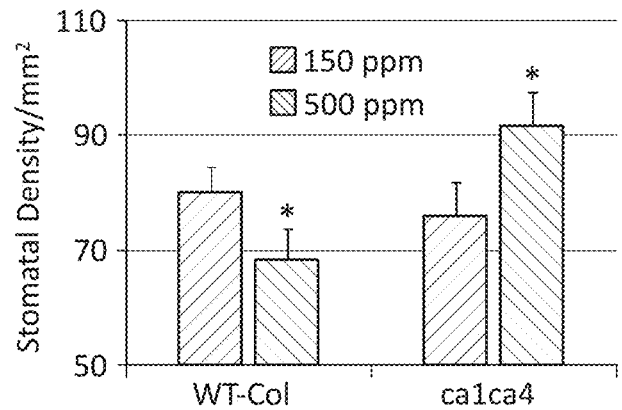

In recent research, we identified mutations in the *Arabidopsis* β-carbonic anhydrase genes AtCa1 (At3g01500) and AtCa4 (At1g70410) that are impaired in the rapid short-term CO2-induced stomatal movement response[6]. We investigated whether the long-term CO2 control of stomatal development is altered in the ca1ca4 double mutant plants. ca1ca4 mutant and wild type plants are morphologically indistinguishable (FIG. 1a). No obvious aberrations in stomatal shape or size were found in the ca1ca4 mutant (FIG. 1b). We analyzed the stomatal index of wild type and ca1ca4 mutant plants grown at low (150 ppm) and elevated (500 ppm) CO2 (stomatal index=the percent of epidermal cells which are stomata). In the wild type (Columbia), plants grown at elevated [CO2] of 500 ppm have, on average, 8.9% fewer stomata than low CO2-grown plants (FIG. 1c, d; similar to the C24 ecotype[5]). Interestingly, the ca1ca4 mutant did not show an elevated CO2-induced repression of stomatal index but surprisingly, an average 22.1% increase in stomatal index (P=0.02306, FIG. 1c, d). Similar results were obtained when stomatal density measurements were analyzed (FIG. 1e). The only other known mutant impaired in CO2 control of stomatal development, hic, also shows this inverted CO2 response, with increased stomatal index at elevated CO2.

Examination of the epidermis of ca1ca4 mutant plants revealed that adjacent stomata had at least one epidermal cell between them, indicating that spacing divisions were enforced early during protoderm development (FIG. 1b). This suggests that the greater stomatal index observed in the ca1ca4 mutant results from early cell fate specification events in the developing protoderm as opposed to ectopic stomatal development in the mature epidermis.

The wild type and ca1ca4 mutant plants grown at 150 ppm $CO_2$ were smaller than their 500 ppm-grown counterparts; cotyledons and leaves of the wild type and the ca1ca4 mutant were similar in size and shape at both $CO_2$ concentrations (FIG. 1a). Because seedlings grown at 150 ppm $CO_2$ have smaller leaf areas (FIG. 1a), such size differences may generate artifacts when measuring and using stomatal density (number of stomata per unit area of the leaf epidermis; FIG. 1e). Hence, in this study, we conservatively employ stomatal index analyses (which measure the percent of epidermal cells that are stomata) as a reliable measure of comparing stomatal developmental changes between $CO_2$ treatments. Additionally, as multiple environmental stimuli can influence stomatal development, for all experiments, wild type controls were grown in side-by-side and analyzed with the corresponding mutants in blinded genotype analyses.

Figure 1F:
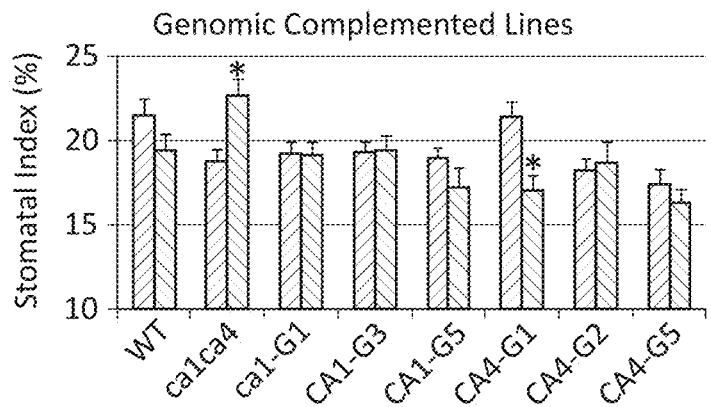
Figure 1G:
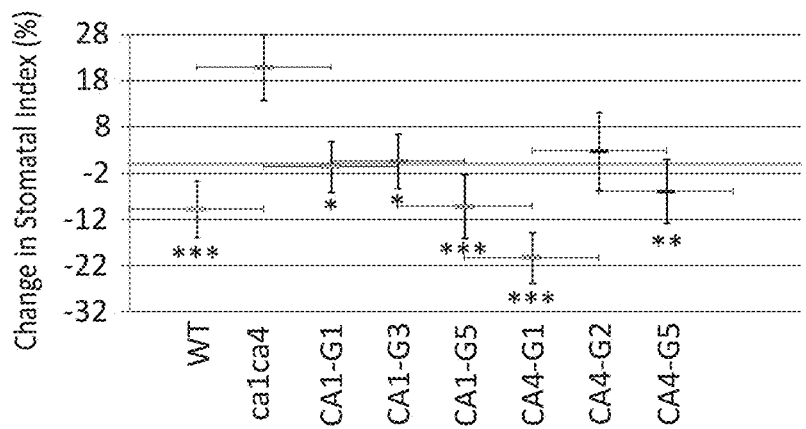

We transformed the ca1ca4 mutant with single genomic constructs expressing either AtCa1 (At3g01500) or AtCa4 (At1g70410) and investigated complementation of their stomatal development responses to $CO_2$. Six independent complementation lines analyzed for either AtCa1 or AtCa4 showed a significant suppression of the elevated $CO_2$-induced inversion in stomatal index found in the ca1ca4 double mutant plants (FIG. 1f,g). In contrast, ca1ca4 mutant leaves showed an average of 20.9% more stomata than wild type at elevated $CO_2$. The complemented lines showed varying levels of elevated $CO_2$-mediated suppression in stomatal development compared to the ca1ca4 double mutant plants (FIG. 1f,g).

The β-carbonic anhydrase genes CA1 (At3g01500) and CA4 (At1g70410) are highly expressed in guard cells[6]. In order to gain insight into the cell types and developmental stages at which βCA1 and βCA4 mediate $CO_2$ control of stomatal development, we tested the effects of preferential expression of these native *Arabidopsis* carbonic anhydrases in mature guard cells[6,1], as YFP fusion proteins (FIG. 2a-c). These cell-type specific complementation studies showed that $CO_2$ control of stomatal development can be partially restored in the ca1ca4 mutant by either CA1 or CA4 expression preferentially in mature guard cells (FIG. 2a-d). This result provides initial evidence for a non cell-autonomous character of $CO_2$ signaling mediated by these carbonic anhydrases emanating from mature guard cells during protodermal cell fate specification in developing cotyledons and leaves (FIG. 2a-d).

Figure 2E:
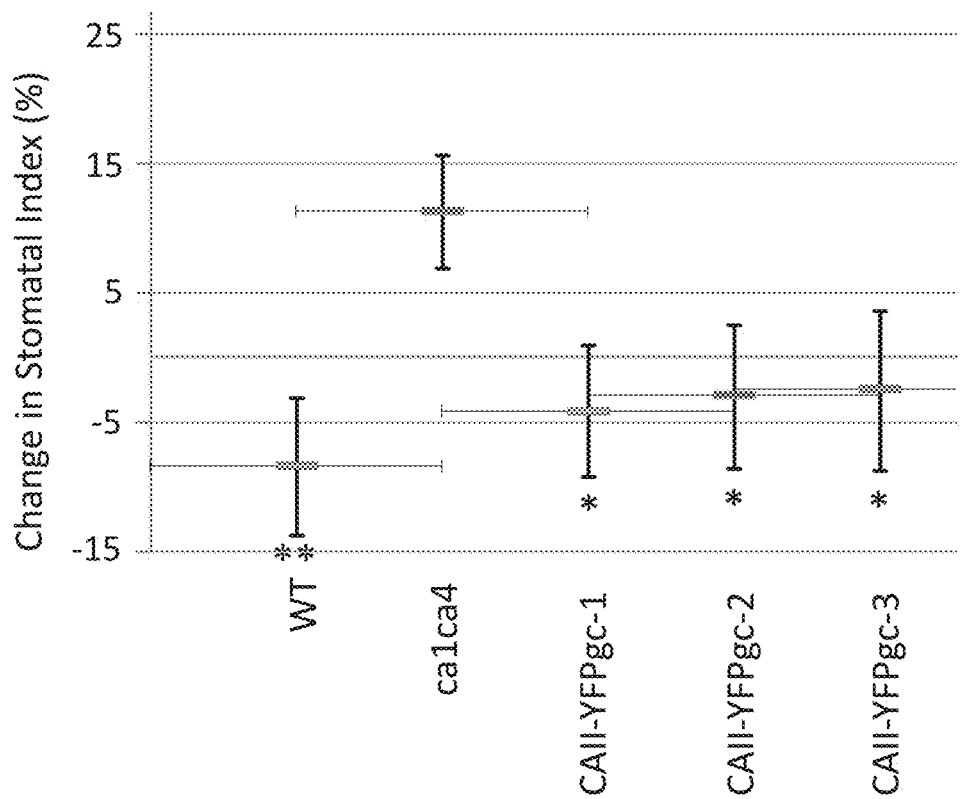
FIG. 2|Mature guard cell targeted catalytic activity of carbonic anhydrase is sufficient for non cell-autonomous suppression of enhanced stomatal development mediated by elevated $CO_2$ in ca1ca4. Altering rapid $CO_2$- and abscisic acid-induced stomatal movements and transpiration efficiency does not cause an inversion in elevated $CO_2$-mediated control of stomatal development. a-d Expression of either AtCa1 or AtCa4 in mature guard cells suppresses inversion of stomatal development in ca1ca4 mutant plants at elevated $CO_2$. a, Model for epidermal cell differentiation in an immature cotyledon. Green color depicts older cells which have differentiated stomata and red color depicts epidermal cells, illustrating mature guard cell targeting of pGC1::CAII-YFP. d, Stomatal index quantitation in 10 day old seedlings of six independent lines of the ca1ca4 mutant plants complemented with YFP fusion constructs for either AtCa1 (CA1-YFP) or AtCa4 (CA4-YFP) showing elevated $CO_2$-induced changes in stomatal index presented as percent changes in stomatal index at 500 ppm $CO_2$ (compared to 150 ppm $CO_2$) alongside the wild type and the ca1ca4 mutant plants. e, Human a-carbonic anhydrase activity in mature guard cells suppresses the inverted stomatal development phenotype of the ca1ca4 mutant at elevated $CO_2$. Quantitation of three independent lines of the ca1ca4 mutant complemented with guard cell preferential over-expression of a YFP fusion of the Human Alpha carbonic anhydrase II exhibiting elevated $CO_2$-induced changes in stomatal index shown as percent changes in stomatal index at 500 ppm $CO_2$ (compared to 150 ppm $CO_2$) alongside the wild type and the ca1ca4 mutant. f-g, Altering rapid $CO_2$- and abscisic acid-induced stomatal movements and transpiration efficiency does not cause an inversion in elevated $CO_2$-mediated control of stomatal development. f, Bar graphs showing stomatal index in wild type Columbia and the ost1-3 mutant at low and elevated $CO_2$.

We next interrogated whether carbonic anhydrase enzyme activity or the specific structure of AtβCA1 and AtβCA4 are important for mediating $CO_2$ control of stomatal development. We transformed the ca1ca4 mutant with the unrelated human α-CAII 6 as a YFP fusion protein under the control of a mature guard cell preferential promoter (pGC1; FIG. 2b,c). Human αCAII has low protein sequence identity to the *Arabidopsis* βCA1 (9%) and βCA4 (12%) 6 and as such, is an ideal candidate for these studies. In all three independent complementation lines tested, the high $CO_2$-induced inversion in stomatal index of ca1ca4 mutant plants was partially suppressed by mature guard cell-targeted expression of the human carbonic anhydrase gene (FIG. 2e). This result suggests that carbonic anhydrase catalytic activity may be required for $CO_2$ control of stomatal development. Furthermore, these findings indicate that carbonic anhydrase activity in mature guard cells can function in the perception/ initial signal relay of $CO_2$ and that this perceived signal can be transmitted non cell-autonomously from mature guard cells (FIG. 2b) to developing protodermal cells (FIG. 2a-e) to mediate $CO_2$ control of stomatal development.

Figure 2F:
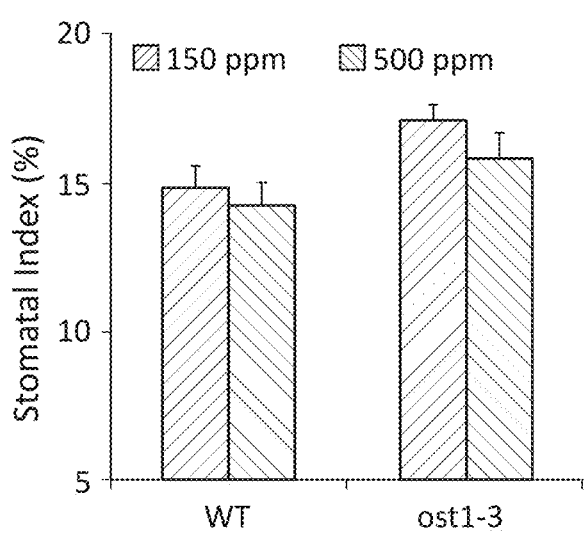

Leaf transpiration rates control stomatal development[22]. As $CO_2$ levels affect transpiration by regulating stomatal movements[9,12], in addition to stomatal development, we examined whether the processes governing transpiration and $CO_2$ control of stomatal movements are distinct from $CO_2$ regulation of stomatal development. We chose the open stomata 1 (OST1) protein kinase mutant for these studies as OST1 is an upstream regulator of ABA-induced stomatal closure and mutations in this gene result in plants which show a higher transpiration rate[23]. Furthermore, OST1 is a key mediator of $CO_2$-induced stomatal closure downstream of carbonic anhydrases[24] and whether $CO_2$ control of stomatal development requires Ost1 is unknown. Thus we investigated whether ost1 mutant plants also show an inversion of the $CO_2$-controlled stomatal developmental response. ost1 mutant plants grown at elevated $CO_2$ showed an average 7.3% reduction in stomatal index (FIG. 2O). Furthermore, ost1-1 mutant leaves had a slightly higher stomatal index compared to wild type leaves at low and elevated $CO_2$ (FIG. 2f, P=0.097 at 150 ppm). Hence we conclude that disrupted stomatal movements and increased transpiration in the ost1 mutant[23] do not impede the ability of the plant to regulate stomatal development in response to $CO_2$. Additionally, OST1 functions in $CO_2$ control of stomatal movements downstream of CAs24, but not in $CO_2$ control of stomatal development (FIG. 2O, indicating an important divergence point in the $CO_2$ signaling pathway for these two distinct responses.

Figure 3A:
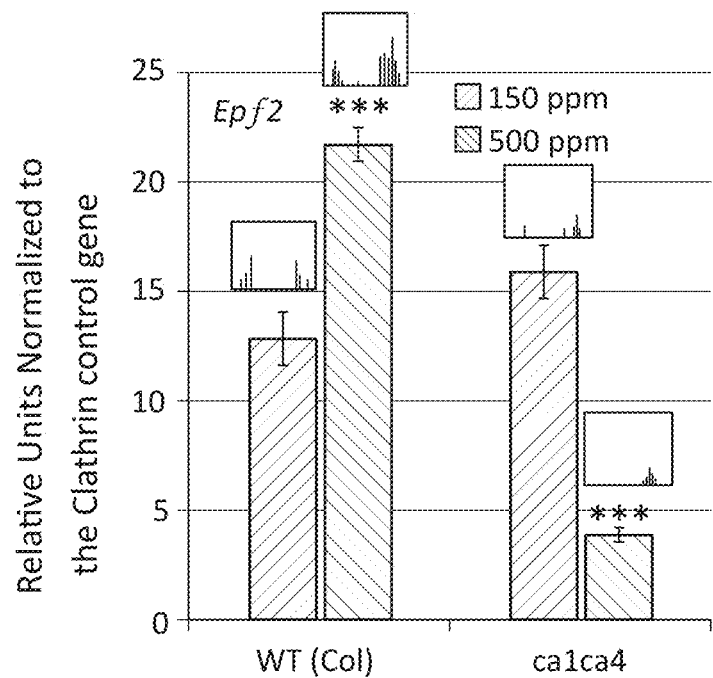
FIG. 3|Epf2 is regulated by [$CO_2$] and is essential for $CO_2$ control of stomatal development. a, Epf2 transcript levels are induced at elevated $CO_2$ in WT, but not ca1ca4 plants. Epf2 mRNA levels (qPCR, n=3 from ~500 pooled seedlings) in developing (5DAG) cotyledons of wild type and ca1ca4 mutant seedlings grown at 150 ppm and 500 ppm $CO_2$. Expression levels were normalized to the Clathrin control gene. Inset boxes indicate RNA-Seq expression profiles for each sample. b-d, MUTE expression correlates with the stomatal density phenotype of the ca1ca4 mutant. b, c Confocal images showing MUTEpro::nucGFP expression (green) in developing (5DAG) cotyledons of wild type (b) and ca1ca4 (c) plants. d, Quantitation of MUTEpro::nucGFP expressing cells in wild type and 2 independent lines in the ca1ca4 mutant background. e, er, erl1erl2/+triple mutants show an inversion of the elevated $CO_2$-mediated control of stomatal development. Bar graphs showing stomatal index in wild type Columbia and the er, erl1erl2/+triple mutant at low and elevated $CO_2$.
Figure 3B:
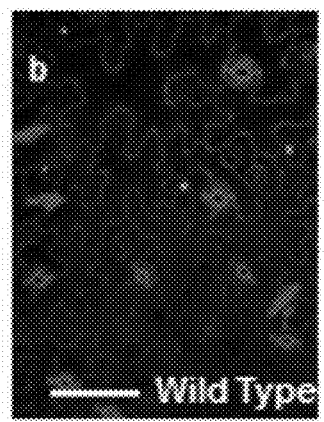
Figure 3C:
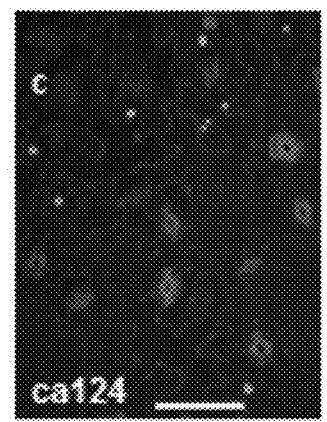
Figure 3D:
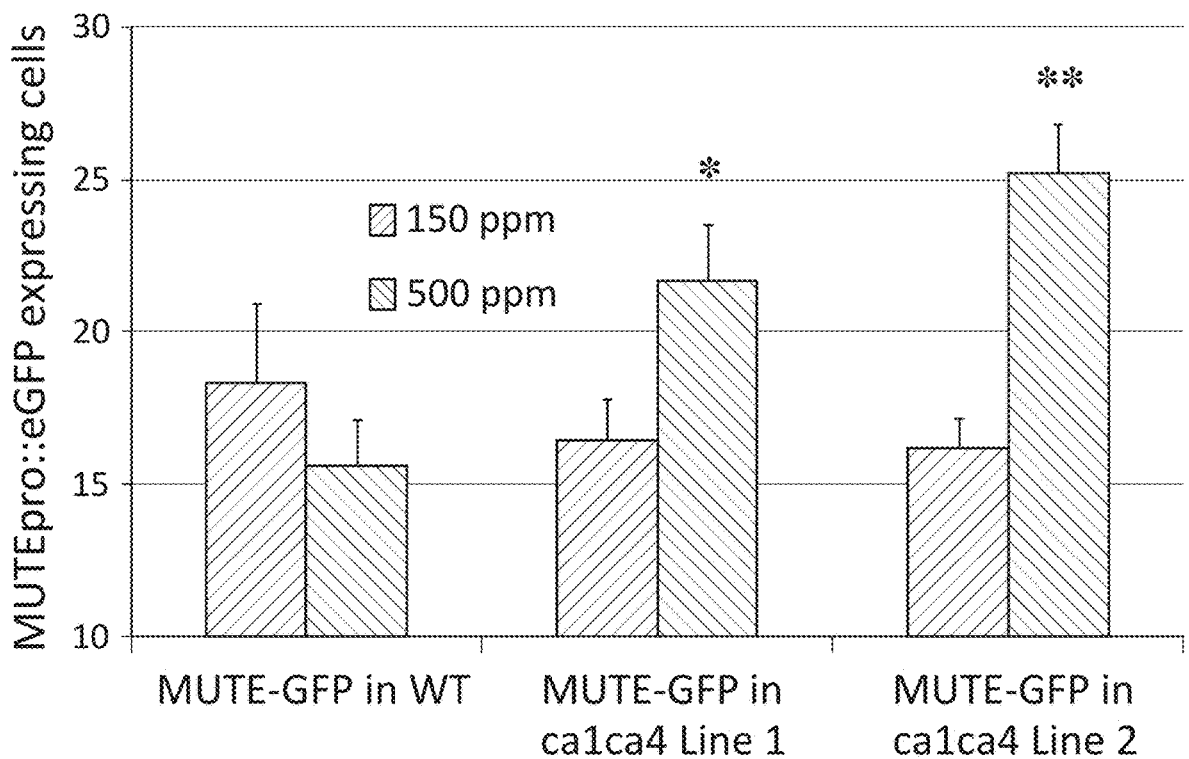
Figure 3E:
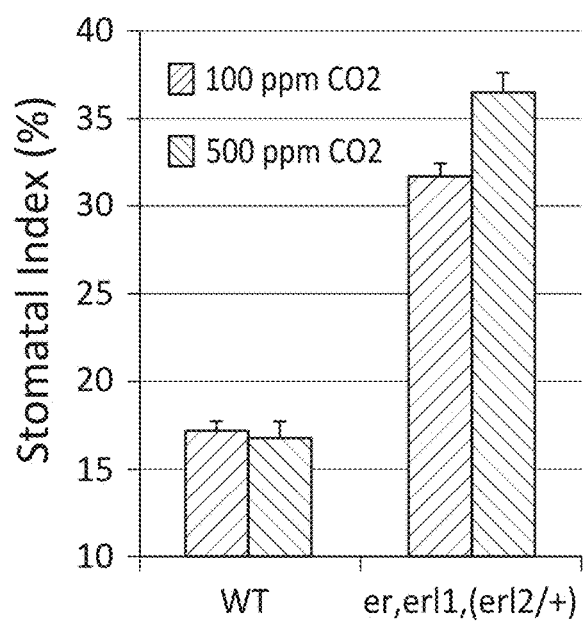

To gain initial insight into the regulatory mechanisms through which elevated $CO_2$ signaling exerts repression of stomatal development, we conducted high throughput RNA-Seq transcriptomics on immature *Arabidopsis* seedlings grown at low and elevated $CO_2$. These analyses and independent single gene qPCR studies of developing cotyledons show an upregulation of Epf2[7,8] transcripts in the wild type and a dramatic downregulation in the ca1ca4 mutant (FIG. 3a). Our mature guard cell complementation analyses support a role for cell-cell signaling in elevated $CO_2$-mediated repression of stomatal development (FIG. 2). The secreted EPF peptides have been identified as extracellular ligands that mediate cell-cell control of stomatal development[7,8,16]. EPF2 acts upstream of MUTE, early at the stage of protodermal cell fate specification and, controls cell entry into the stomatal lineage by limiting asymmetric divisions[7,8]. We transformed and examined wild type and ca1ca4 mutant plants harboring a MUTEpro::nucGFP construct. Mute[17,18] expression is a reliable indicator of cells entering the stomatal lineage because it is induced early 1 during meristemoid specification and is not expressed transiently. Compared to wild type, ca1ca4 plants expressed MUTEpro::GFP in 33% more cells, on average, at elevated $CO_2$ but not at low $CO_2$ (FIG. 3b-d). The MUTEpro::nucGFP expression correlates with the increased stomatal index found at elevated $CO_2$ in ca1ca4 mutant leaves (FIG. 1c) and suggests that the increased stomatal development in the mutant progresses via components upstream of MUTE. These data correlate well with our observations of Epf2 gene expression in response to $CO_2$ elevation. We tested whether genetic perturbation of Epf2 would result in an abnormal stomatal development responses to [CO2]. Remarkably, two independent single mutant alleles tested for epf2 show a clear inversion in CO2 control of stomatal development (FIG. 4a) with an average of 23.4% (FIG. 4a) more stomata at elevated CO2, when compared to plants grown at low CO2. Recent research shows that EPF2-ERECTA form a ligand-receptor pair[25]. We tested the relevance of this finding to CO2 control of stomatal development and found that the erecta, erecta-like1, erecta-like2/+triple mutant leaves (er,erl1erl2/+) shows an inversion in the stomatal development response at elevated CO2 (FIG. 3e) which is similar to the epf2 single mutants. This additional genetic evidence points to a pathway by which CO2 status is signaled in plants at elevated CO2 via a negative regulating ligand-receptor pair during stomatal development.

Figure 5A:
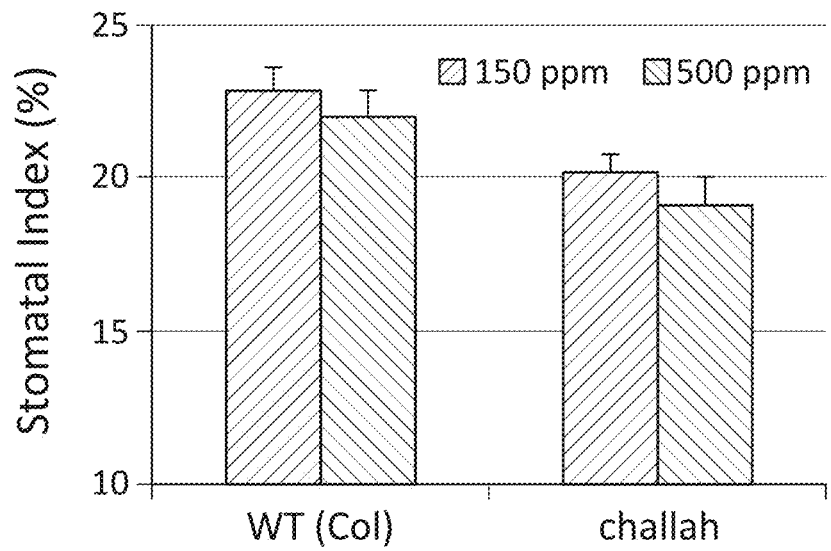
FIG. 5|Mutations in negative regulatory extracellular signals of stomatal development, EPF1 and CHALLAH maintain $CO_2$ control of stomatal development. a-b, Bar graphs showing stomatal index in wild type Columbia, (a) the epf1-1 single mutant, (b) the challah single mutant plants.
Figure 5B:
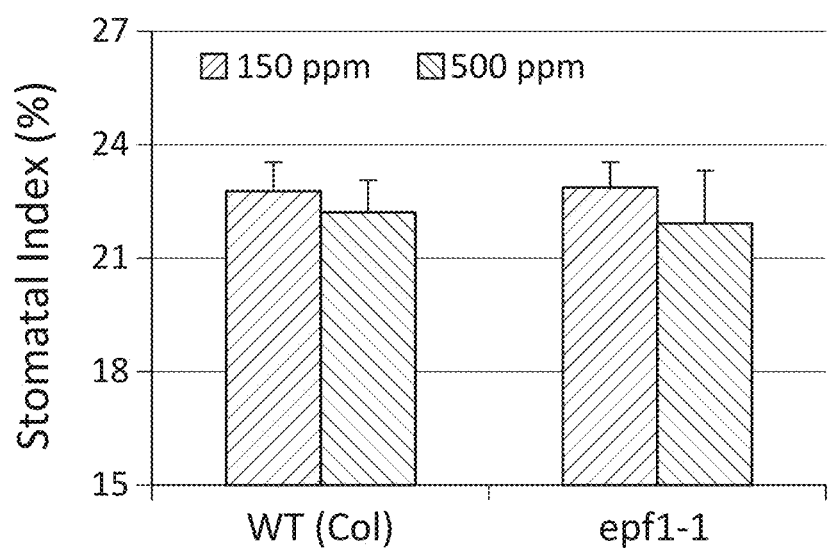
Figure 6:
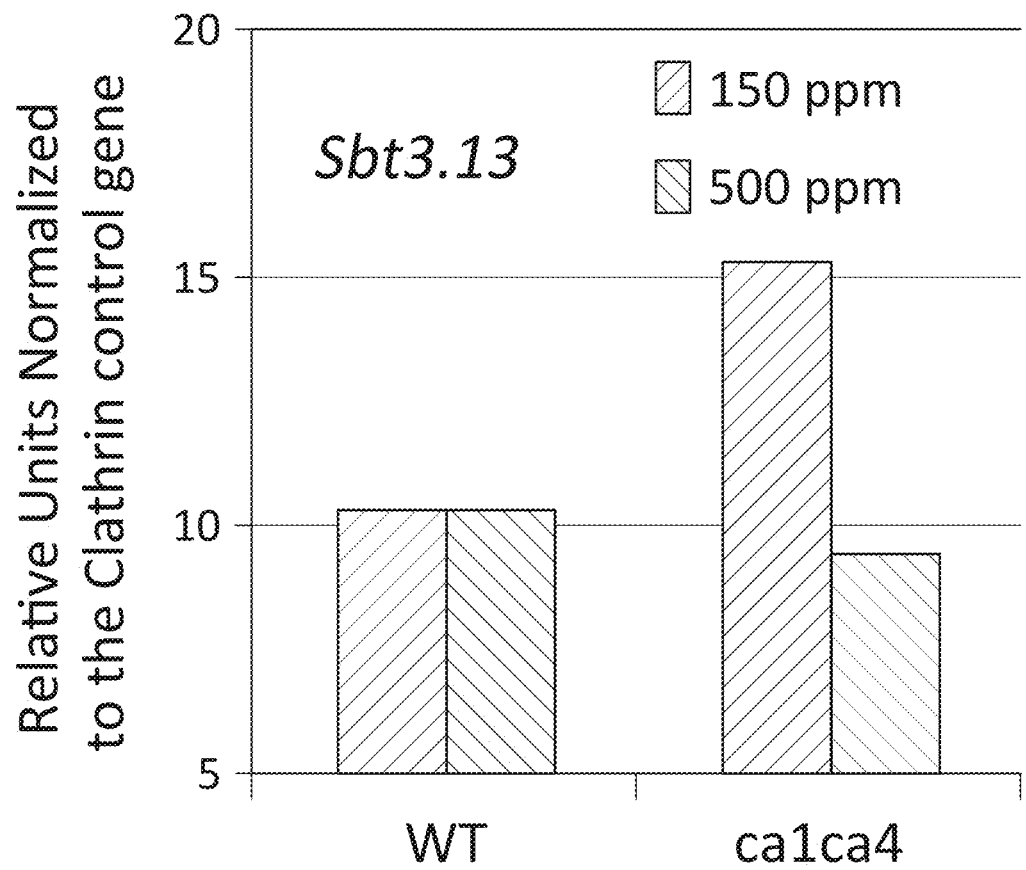
FIG. 6|Sbt3.13 transcript levels are not induced by elevated $CO_2$ in wild type plants. Bar graphs showing qPCR results for mRNA levels in developing (5DAG) cotyledons of wild type and ca1ca4 mutant seedlings grown at 150 ppm and 500 ppm $CO_2$ (n=3 from ~500 pooled seedlings). Expression levels were normalized to the Clathrin control gene.

Conversely, the epf1-1 mutant, which acts downstream of MUTE in stomatal development1[6], does not show an inversion of the CO2-controlled stomatal development response to elevated CO2 (Supplemental FIG. 1a), consistent with our finding that CO2 regulates stomatal development upstream of Mute expression (FIG. 3-d). Mutation of a related negative regulatory secreted peptide, challah[26], also did not invert the CO2-controlled developmental response (FIG. 5b). These findings strongly suggest that EPF2 is an upstream mediator of CO2-regulated cell fate specification, that CA1 and CA4 control $CO_2$ regulation of Epf2 expression and that EPF2 is a key transducer of elevated CO2-exerted repression of stomatal development in the protoderm of developing cotyledons and leaves.

Figure 4A:
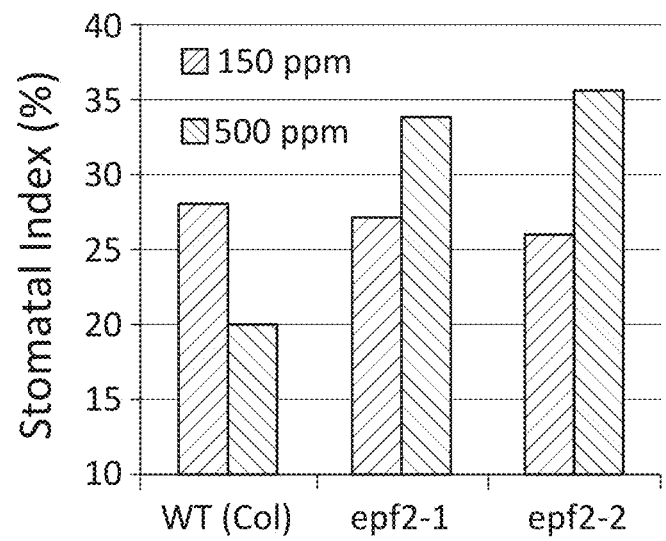
FIG. 4|A leaf apoplast-identified and $CO_2$-regulated secreted subtilisin-like serine protease (CRSP) and EPF2 are key mediators of elevated $CO_2$-regulated repression of stomatal development. a, epf2 mutants show an inversion of the elevated $CO_2$-mediated control of stomatal development. Bar graphs showing stomatal index in wild type Columbia and two independent mutant alleles of epf2 at low and elevated $CO_2$. b, Mutation of the negative regulatory protease involved in stomatal development, SDD1, does not cause an inversion in the $CO_2$ control of stomatal development. Bar graphs showing stomatal index in wild type (C24 accession) and the sdd1-1 mutant grown at 150 ppm and 500 ppm $CO_2$. c-e, Crsp (Sbt5.2) transcript levels are induced at elevated $CO_2$ and crsp mutants show an inversion of the elevated $CO_2$-mediated repression of stomatal development. c, MS/MS spectrum (PROTEINPILOT™) of leaf (56DAG) apoplastic proteome peptide identification and peptide sequence identifies the subtilisin-like serine protease AtSBT5.2. d, $CO_2$ control of Sbt5.2 mRNA levels in developing (5DAG) cotyledons of wild type and ca1ca4 mutant seedlings grown at 150 ppm and 500 ppm $CO_2$. Expression levels were normalized to the Clathrin control gene. e, Bar graphs showing stomatal index in wild type Columbia and two independent alleles for the sbt5.2 mutant at low and elevated $CO_2$.
Figure 4B:
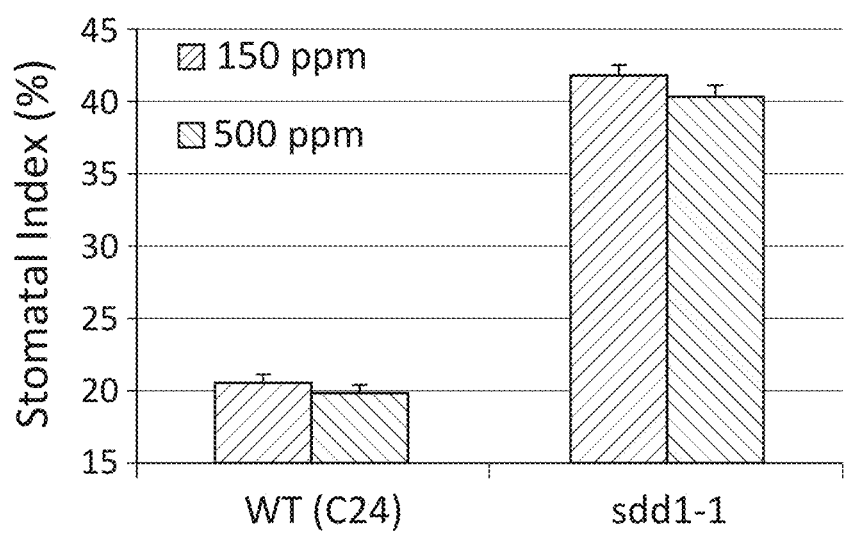

EPF2 belongs to a family of 11 EPF and EPFL peptide proteins, which are predicted to have a putative cleavage site, which upon cleavage converts the pro-peptide into an active peptide ligand isoform[19,26,25]. Hence we tested a mutant in the Sdd1 gene, which has been shown to be a negative regulator of stomatal development and which encodes an extracellular Subtilisin-like serine protease[15]. The stomatal index of the sdd1-1 mutant is much higher than its C24 wild type accession; FIG. 4b). The sdd1-1 mutant shows, on average, a 4.2% decrease in stomatal index at elevated CO2, similar to the wildtype C24 background line (FIG. 4b). This result indicates that SDD1 is not involved in CO2 control of stomatal development, consistent with studies suggesting that SDD1 does not function in the same pathway as EPF2 7,8 and that extracellular proteases that function in the EPF1, EPF2 and STOMAGEN pathways remain unknown.

Figure 4C:
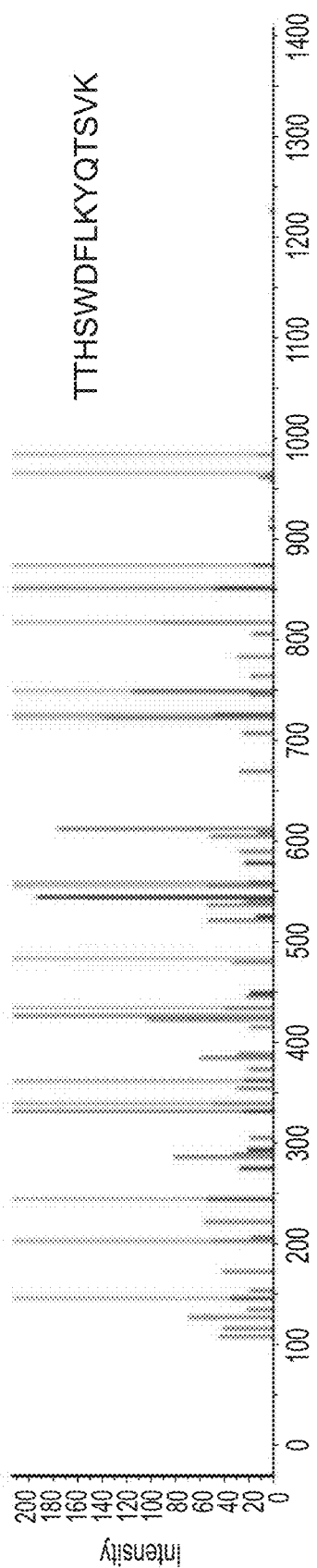
Figure 4D:
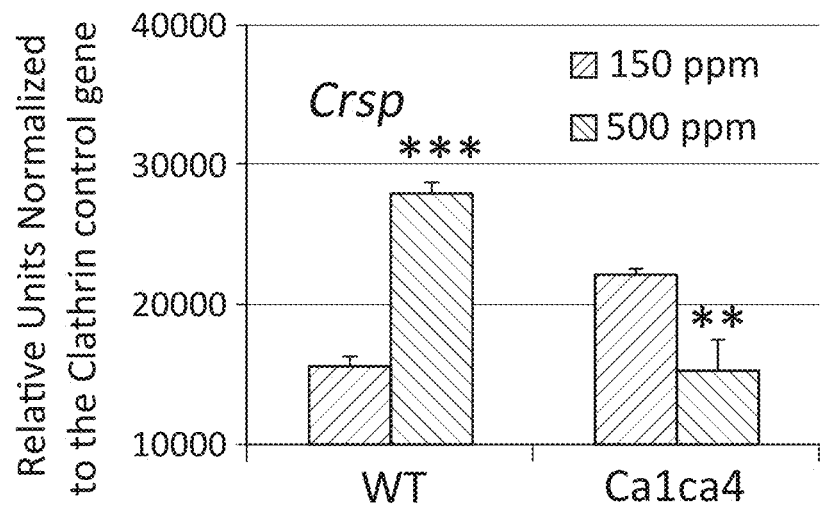
Figure 4E:
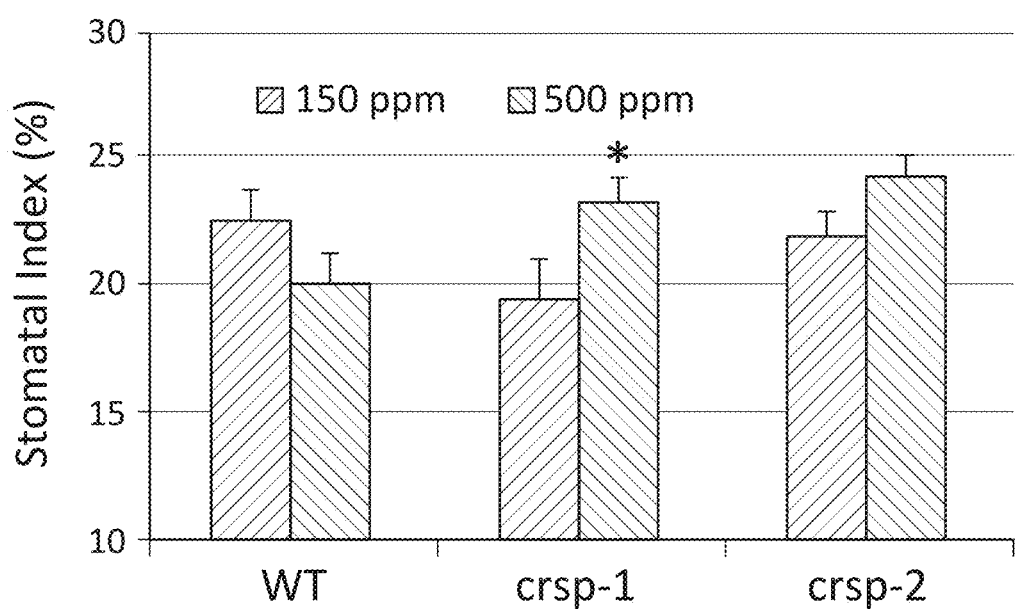
Figure 7:
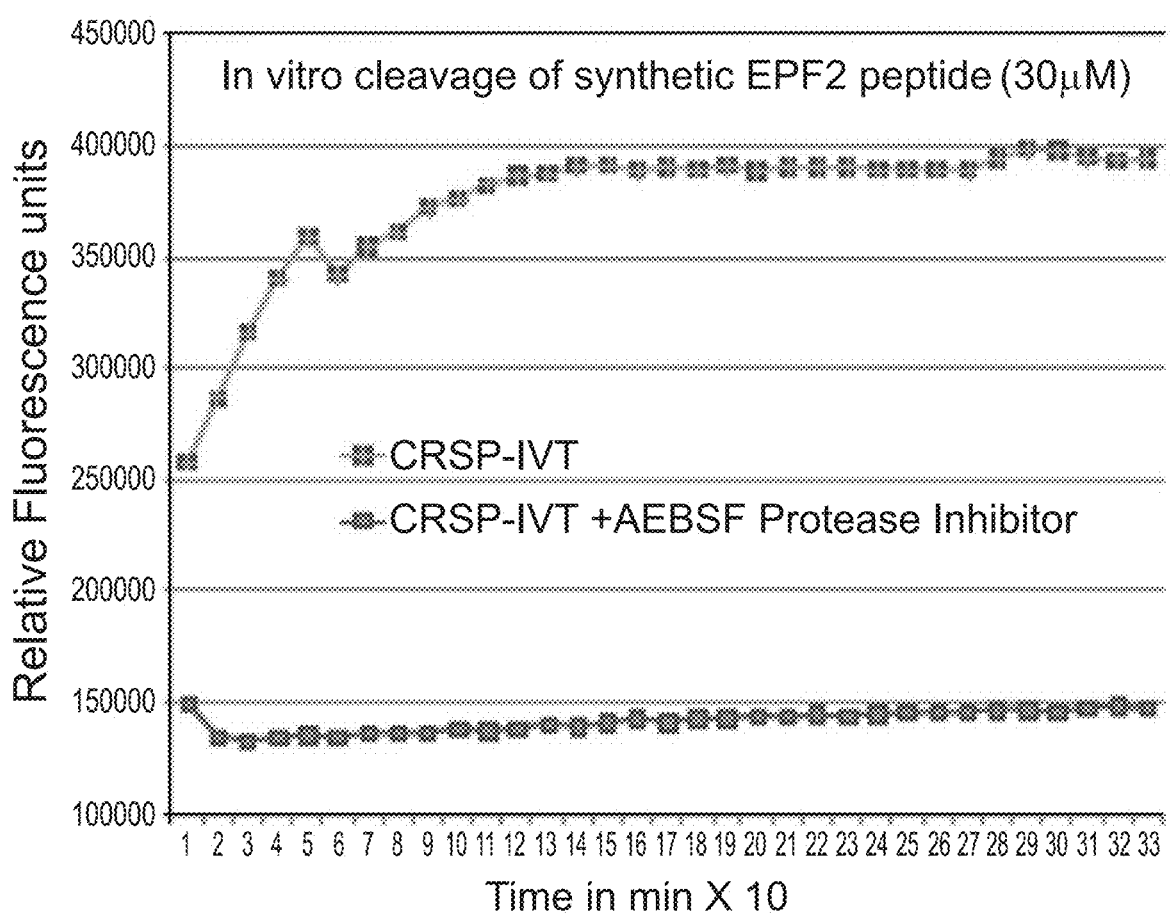
FIG. 7|CRSP cleaves EPF2 in vitro. Fluorescence emitted as a function of time indicating synthetic EPF2 peptide cleavage by the CRSP protease ($CO_2$-regulated secreted subtilisin-like serine protease (CRSP)) synthesized in vitro using the wheat germ cell-free extract system (IVT) in the presence or absence of protease inhibitor cocktail (AEBSF).

We hypothesized that there may be a distinct extracellular protease which mediates CO2 control of stomatal development. SDD1 belongs to a wider subtilisin-like serine protease family (subtilases) which contains 56 members. We pursued proteomic analyses of apoplastic proteins in leaves and identified two Subtilisin-like serine proteases, SBT3.13 and SBT5.2 (FIG. 4c), which are distantly related to SDD1. Interestingly, qPCR data of developing cotyledons show a dramatic increase in Sbt5.2 transcript in the wild type at elevated CO2 (FIG. 4d). In contrast, the ca1ca4 mutant fails to show this increase in Sbt5.2 transcript and instead shows a downregulation of Sbt5.2 at elevated CO2 (FIG. 4d), similar to CO2 regulation of Epf2 expression (FIG. 3a). We named this protease (Sbt5.2) Crsp for CO2 Responsive Secreted Protease. We tested 2T-DNA insertion alleles for CO2 control of stomatal development for each of these extracellular proteases. Interestingly, the crsp mutant alleles show a deregulation of stomatal development with more stomata at elevated CO2 than at low CO2 (FIG. 4e). To determine whether the EPF2 pro-peptide can be cleaved by CRSP, we constructed a synthetic peptide spanning the predicted EPF2 cleavage site and subjected this peptide (synEPF2) to in vitro proteolysis using CRSP synthesized in vitro (wheat germ extract system). The synEPF2 peptide is flanked by fluorophore and quencher moieties and fluorescence can be measured when the quencher-fluorophore interaction is disrupted by cleavage of synEPF2. The CRSP protease shows dramatic cleavage of synEPF2 in vitro and this cleavage is abolished by the inclusion of protease inhibitors in the reaction (FIG. 7). Presently, no environmental signals are known that mediate control of stomatal development via the extracellular pro-peptides EPF1, EPF2, and STOMAGEN or the SDD1 protease. Together, these findings point to the novel extracellular protease, CRSP, that functions as a mediator of the CO2-controlled stomatal development response and further suggest the exciting possibility that proper activity of the negative regulator EPF2 depends on CRSP function.

Atmospheric CO2 elevation causes a repression of stomatal development and also reduces the stomatal pore size of plants which causes leaf temperature to rise due to a decrease in the plant's evapotranspirative cooling ability, while simultaneously decreasing the transpiration efficiency of plants. This phenomenon combined with the increasing scarcity of fresh water for agriculture are predicted to dramatically impact plant health[12,27-29]. Presently, the only known mutant gene, hic, exhibiting a de-regulation of CO2 control of stomatal development has been proposed to have defects in guard cell wall permeability, which may alter the diffusibility of extracellular stomatal cell fate determinants5. However, the molecular mechanisms mediating CO2 control of stomatal development have remained unknown. We have uncovered key elements in a long sought pathway by which elevated CO2 controls cell fate and stomatal development in plants[4]. The results of our studies identify three new key players in CO2 control of stomatal development: βCA1/βCA4, CRSP and EPF2.

The present data point to a framework of CO2 control of stomatal development in which the β-carbonic anhydrases CA1 and CA4 function non cell-autonomously in catalytically transducing the elevated [CO2] signal. CO2 elevation induces Epf2 and Crsp mRNAs in wildtype, but not in ca1ca4 mutant leaves (FIGS. 3a and 4d). We have identified an extracellular protease, CRSP, that is essential for CO2-induced repression of stomatal development. EPF2 peptides are predicted to be cleaved for signaling during repression of stomatal development[19,20], but not by the SDD1 protease[7,8]. Thus CRSP may cleave and activate EPF2 to mediate repression of stomatal development upon an elevated CO2 stimulus. In the genetic mutants disrupting this elevated CO2-mediated induction of Crsp and Epf2 signaling, competing extracellular signals that promote stomatal development, in particular the STOMAGEN peptide[20], could cause the inverted CO2 control of stomatal development found here for the ca1ca4, epf2 and crsp mutants. As plants grow and adapt to the continuing rise in atmospheric CO2 levels, an understanding of the key genetic players that mediate this CO2-controlled plant developmental response is critical for agriculturally relevant efforts aimed at ameliorating water use efficiency and heat resistance in plants.

Methods:

Plant Growth and Statistical Analyses:

Note that absolute stomatal indices and the degree of change in indices varied slightly from experiment to experiment, similar to previous studies5. Additionally, as multiple environmental stimuli can influence stomatal development and control baseline stomatal density or indices can vary slightly from experiment to experiment, for all experiments, wild type controls were grown side-by-side and data from within each experiment were analyzed with the corresponding mutants in blinded genotype analyses. Furthermore, all experiments were repeated at least three times and blind experiments were conducted in which either the genotype, or both the genotype and CO2 concentration (double blind) were unknown to the experimenter until after data quantitation was completed for all types of experiments.

In all figures, statistical comparisons were conducted using the OriginPro 8.6 software package for individual genotypes between CO2 treatments or compared to the WT or the ca1ca4 mutant data using ANOVA and Bonferoni post tests. *=P<0.00005, =P<0.005, *=P<0.05.

Apoplast proteomic analyses were conducted on 8 week old leaves.

REFERENCES EXAMPLE 2

1 Bergmann, D. C. & Sack, F. D. Stomatal Development. *Annual Review of Plant Biology* 58, 163-181 (2007).
2 Pillitteri, L. J. & Torii, K. U. Mechanisms of Stomatal Development. *Annu Rev Plant Biol* (2012).
3 Nadeau, J. A. & Sack, F. D. Control of stomatal distribution on the *Arabidopsis* leaf surface. *Science* 296, 1697-1700 (2002).
4 Woodward, F. I. Stomatal numbers are sensitive to increases in $CO_2$ from pre-industrial levels. *Nature* 327, 617-618 (1987).
5 Gray, J. E. et al. The HIC signaling pathway links $CO_2$ perception to stomatal development. *Nature* 408, 713-716 (2000).
6 Hu, H. et al. Carbonic anhydrases are upstream regulators of $CO_2$-controlled stomatal movements in guard cells. *Nat Cell Biol* 12, 87-93 (2010).
7 Hara, K. et al. Epidermal Cell Density is Autoregulated via a Secretory Peptide, EPIDERMAL PATTERNING FACTOR 2 in *Arabidopsis* Leaves. *Plant and Cell Physiology* 50, 1019-1031 (2009).
8 Hunt, L. & Gray, J. E. The signaling peptide EPF2 controls asymmetric cell divisions during stomatal development. *Curr Biol* 19, 864-869 (2009).
9 Kim, T. H., Bohmer, M., Hu, H., Nishimura, N. & Schroeder, J. I. Guard cell signal transduction network: advances in understanding abscisic acid, $CO_2$, and Ca2+ signaling. *Annu Rev Plant Biol* 61, 561-591, doi:10.1146/annurev-arplant-042809-112226 (2010).
10 Stahlberg, R., Van Volkenburgh, E. & Cleland, R. E. Long-distance signaling within *Coleus* x *hybridus* leaves; mediated by changes in intra-leaf CO2? *Planta* 213, 342-351 (2001).
11 Woodward, F. I. Potential impacts of global elevated CO(2) concentrations on plants. *Curr Opin Plant Biol* 5, 207-211 (2002).
12 Hetherington, A. M. & Woodward, F. I. The role of stomata in sensing and driving environmental change. *Nature* 424, 901-908 (2003).
13 Dong, J. & Bergmann, D. C. Stomatal patterning and development. *Curr Top Dev Biol* 91, 267-297 (2010).
14 Torii, K. U. et al. The *Arabidopsis ERECTA* gene encodes a putative receptor protein kinase with extracellular leucine-rich repeats. *Plant Cell* 8, 735-746 (1996).
15 Von Groll, U., Berger, D. & Altmann, T. The subtilisin-like serine protease SDD1 mediates cell-to-cell signaling during *Arabidopsis* stomatal development. *Plant Cell* 14, 1527-1539 (2002).
16 Hara, K., Kajita, R., Torii, K. U., Bergmann, D. C. & Kakimoto, T. The secretory peptide gene EPF1 enforces the stomatal one-cell-spacing rule. *Genes Dev* 21, 1720-1725 (2007).
17 MacAlister, C. A., Ohashi-Ito, K. & Bergmann, D. C. Transcription factor control of asymmetric cell divisions that establish the stomatal lineage. *Nature* 445, 537-540 (2007).
18 Pillitteri, L. J., Sloan, D. B., Bogenschutz, N. L. & Torii, K. U. Termination of asymmetric cell division and differentiation of stomata. *Nature* 445, 501-505 (2007).
19 Kondo, T. et al. Stomatal density is controlled by a mesophyll-derived signaling molecule. *Plant Cell Physiol* 51, 1-8 (2010).
20 Sugano, S. S. et al. Stomagen positively regulates stomatal density in *Arabidopsis*. *Nature* 463, 241-244 (2010).
21 Yang, Y., Costa, A., Leonhardt, N., Siegel, R. S. & Schroeder, J. I. Isolation of a strong *Arabidopsis* guard cell promoter and its potential role as a research tool. *Pl. Methods* 4, 1-15 (2008).
22 Lake, J. A. & Woodward, F. I. Response of stomatal numbers to CO2 and humidity: control by transpiration rate and abscisic acid. *New Phytol* 179, 397-404 (2008).
23 Mustilli, A. C., Merlot, S., Vavasseur, A., Fenzi, F. & Giraudat, J. *Arabidopsis* OST1 protein kinase mediates the regulation of stomatal aperture by abscisic acid and acts upstream of reactive oxygen species production. *Plant Cell* 14, 3089-3099 (2002).
24 Xue, S. et al. Central functions of bicarbonate in S-type anion channel activation and OST1 protein kinase in $CO_2$ signal transduction in guard cell. *EMBO J* 30, 1645-1658 (2011).
25 Lee, J. S. et al. Direct interaction of ligand-receptor pairs specifying stomatal patterning. *Genes Dev* 26, 126-136 (2012).
26 Abrash, E. B. & Bergmann, D. C. Regional specification of stomatal production by the putative ligand CHALLAH. *Development* 137, 447-455 (2010).
27 Sellers, P. J. Modeling the exchanges of energy, water, and carbon between continents and the atmosphere. *Science* 275, 502-509 (1997).
28 LaDeau, S. L. & Clark, J. S. Rising $CO_2$ levels and the fecundity of forest trees. *Science* 292, 95-98 (2001).
29 Battisti, D. S. & Naylor, R. L. Historical warnings of future food insecurity with unprecedented seasonal heat. *Science* 323, 240-244 (2009).
30 Rédei, G. P. *A heuristic glance at the past of Arabidopsis genetics.*, 1-15 (World Scientific, Singapore., 1992).
31 Shpak, E. D., McAbee, J. M., Pillitteri, L. J. & Torii, K. U. Stomatal patterning and differentiation by synergistic interactions of receptor kinases. *Science* 309, 290-293 (2005).
32 Masle, J., Gilmore, S. R. & Farquhar, G. D. The ERECTA gene regulates plant transpiration efficiency in *Arabidopsis*. *Nature* 436, 866-870 (2005).

Example 3: Carbonic Anhydrases, EPF2 and a Novel Protease Mediate $CO_2$ Control of Stomatal Development This example presents data demonstrating the efficacy of the compositions and methods of the invention in meditating, or controlling, or modifying, $CO_2$ control of stomatal function and development.

Here we show that recently isolated *Arabidopsis thaliana* carbonic anhydrase double mutant plants[6] exhibit an inversion in their response to elevated $CO_2$, showing increased stomatal development at elevated $CO_2$ levels. We demonstrate that this stomatal development phenotype is linked to defects in $CO_2$ responsiveness and signal transduction and not a consequence of altered transpiration or stomatal conductance. We have characterized the mechanisms mediating this response and demonstrate non-cell autonomous regulation of $CO_2$-controlled stomatal development by carbonic anhydrases. Transcriptomic RNA-Seq analyses show that the extracellular pro-peptide gene EPF2[7,8], but not EPF1, is induced at elevated $CO_2$ in wildtype, but not ca1ca4 mutant leaves. Moreover, EPF2 is essential for $CO_2$ control of stomatal development. Using cell wall proteomic and $CO_2$-dependent transcriptome analyses, we identified a novel, $CO_2$-induced extracellular protease, CRSP ($CO_2$ Responsive Secreted Protease), as a key mediator of $CO_2$ controlled stomatal development that can cleave the EPF2 signaling peptide. A model for $CO_2$ signaling during protodermal cell fate specification emerges from this research. Our results identify a framework of mechanisms through which continuing atmospheric $CO_2$ elevation reduces stomatal development in leaves via non-cell autonomous carbonic anhydrase-controlled expression of the protease CRSP and the pro-peptide EPF2, which in turn repress stomatal development.

In recent research, we identified mutations in the *Arabidopsis* β-carbonic anhydrase genes CA1 (At3g01500) and CA4 (At1g70410) that are impaired in the rapid, short-term $CO_2$-induced stomatal movement response[6]. Although ca1ca4 plants show a higher stomatal density, it remains unknown whether $CO_2$ control of stomatal development is affected in these plants[6].

Figure 18A:
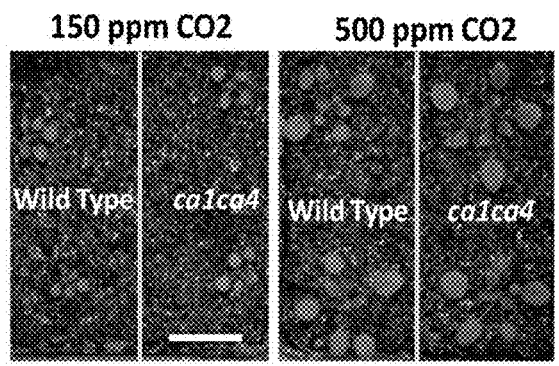
Figure 18B:
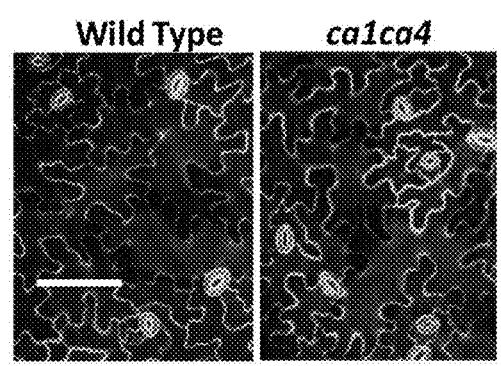
Figure 18C:
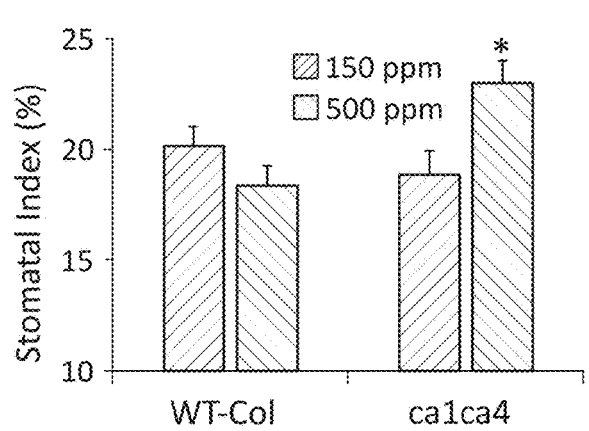
Figure 18D:
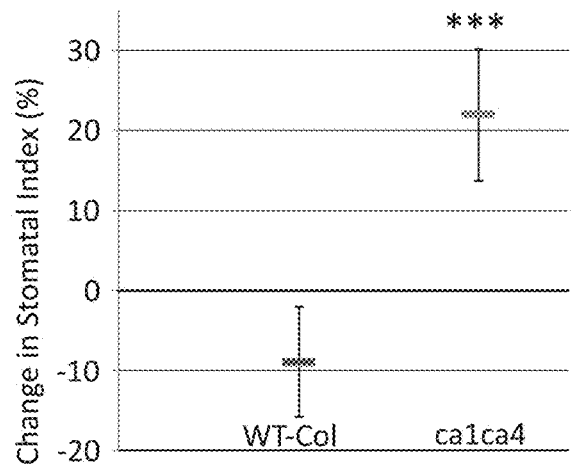
Figure 18E:
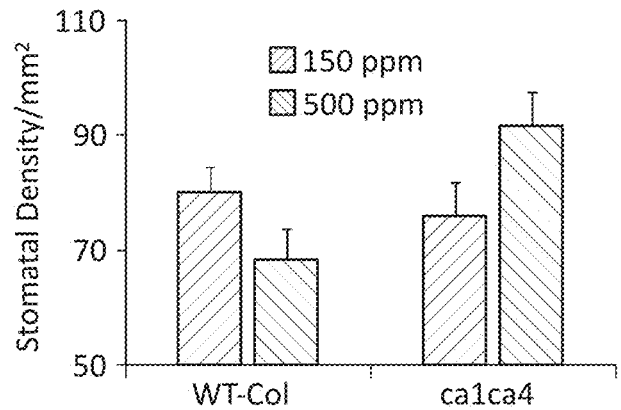

We investigated whether the long-term $CO_2$ control of stomatal development is altered in the ca1ca4 double mutant plants. ca1ca4 mutant and wildtype plants are morphologically indistinguishable under our growth conditions (FIG. 18*a*, or FIG. 1*a* of Example 3). No obvious aberrations in stomatal shape or size were found in the ca1ca4 mutant (FIG. 18*b*, or FIG. 1*b* of Example 3). We analyzed the stomatal index of wildtype and ca1ca4 mutant plants grown at low (150 ppm) and elevated (500 ppm) $CO_2$ (stomatal index=the percent of epidermal cells which are stomata). In the wildtype (Columbia), plants grown at elevated [$CO_2$] of 500 ppm have, on average, 8.9% fewer stomata than low $CO_2$-grown plants (FIG. 18*c*, or FIG. 1*c, d* of Example 3); similar to the C24 ecotype[5]). The ca1ca4 mutant did not show an elevated $CO_2$-induced repression of stomatal index, but interestingly, an average 22.1% increase in stomatal index (P=0.02306, FIG. 18*c, d*, or FIG. 1*c, d* of Example 3). Similar results were obtained when stomatal density measurements were analyzed (FIG. 18*e*, or FIG. 1*e* of Example 3). The presently other known mutant impaired in $CO_2$ control of stomatal development, hic, also shows this inverted $CO_2$ response, with increased stomatal index at elevated $CO_2$[5].

Examination of the epidermis of ca1ca4 mutant plants revealed that adjacent stomata had at least one epidermal cell between them, indicating that spacing divisions were enforced in the mutant during protoderm development (FIG. 18*b*, or FIG. 1*b* of Example 3). This suggests that the higher stomatal index observed in the ca1ca4 mutant may result from early cell fate specification events in the developing protoderm as opposed to ectopic stomatal development in the mature epidermis. The wildtype and ca1ca4 mutant plants grown at 150 ppm $CO_2$ were smaller than their 500 ppm-grown counterparts; cotyledons and leaves of the wildtype and the ca1ca4 mutant were similar in size and shape at each $CO_2$ concentration (FIG. 18*a*, or FIG. 1*a* of Example 3). Because seedlings grown at 150 ppm $CO_2$ have smaller leaf areas (FIG. 18*a*, or FIG. 1*a* of Example 3), such size differences may generate artifacts when analyzing stomatal density (FIG. 18*e*, or FIG. 1*e* of Example 3). Hence, in this study, we employ stomatal index analyses as a reliable measure of comparing stomatal developmental changes between $CO_2$ treatments. Additionally, as multiple environmental stimuli can influence stomatal development, for all experiments, wildtype controls were grown side-by-side and analyzed with the corresponding mutants in blinded genotype analyses.

Figure 18F:
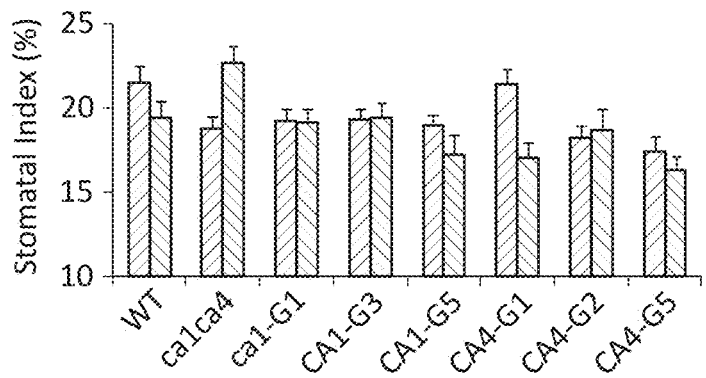
Figure 18G:
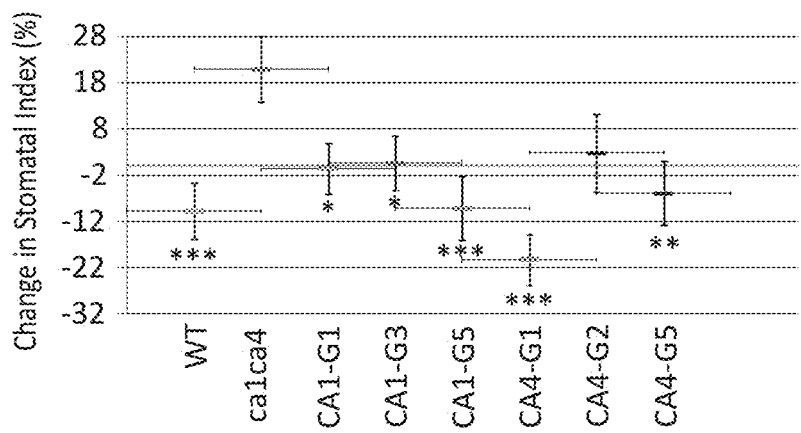

We transformed the ca1ca4 mutant with single genomic constructs expressing either CA1 (At3g01500) or CA4 (At1g70410) and investigated complementation of their stomatal development responses to $CO_2$. Five of six randomly chosen, independent transformant lines for either the CA1 or CA4 gene showed a significant suppression of the elevated $CO_2$-induced inversion in stomatal index found in the ca1ca4 double mutant plants (FIG. 18*f, g*, or FIG. 1*f, g* of Example 3). In contrast, ca1ca4 mutant leaves showed an average of 20.9% more stomata than wildtype at elevated $CO_2$ The complemented lines showed varying levels of suppression of the inverted stomatal development phenotype of ca1ca4 double mutant plants (FIG. 18*f, g*, or FIG. 1*f, g* of Example 3).

Figure 19E:
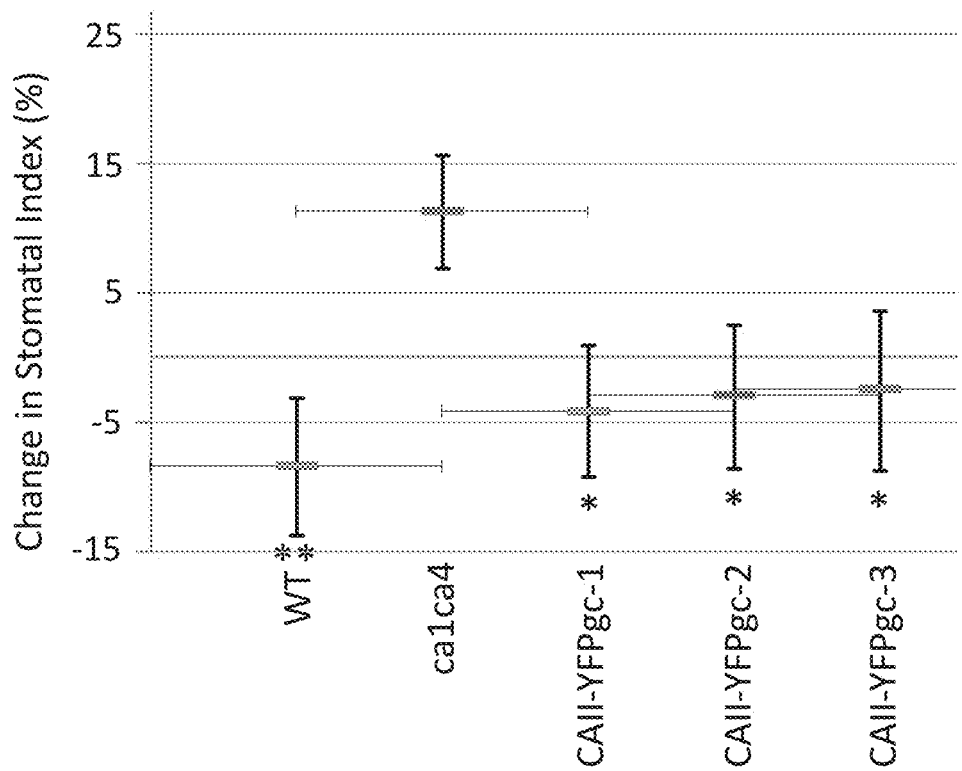
Figure 19F:
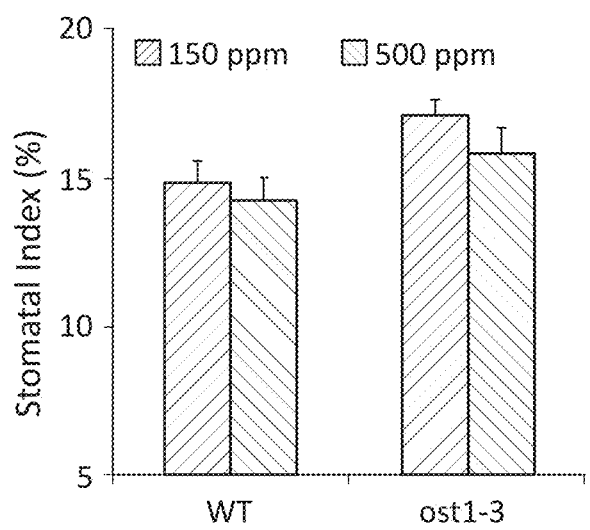
Figure 20A:
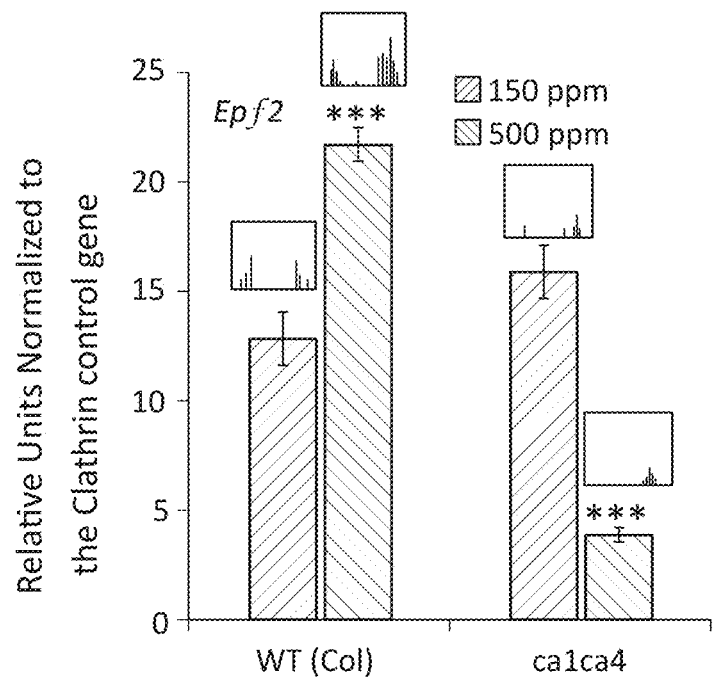
Figure 20B:
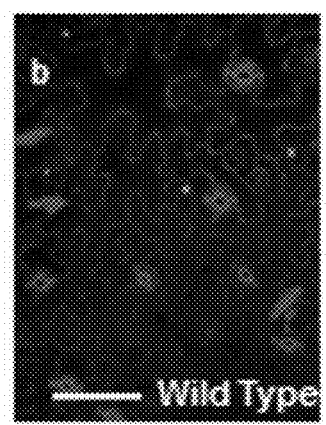
Figure 20C:
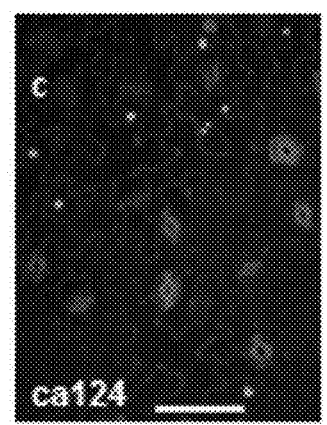
Figure 20D:
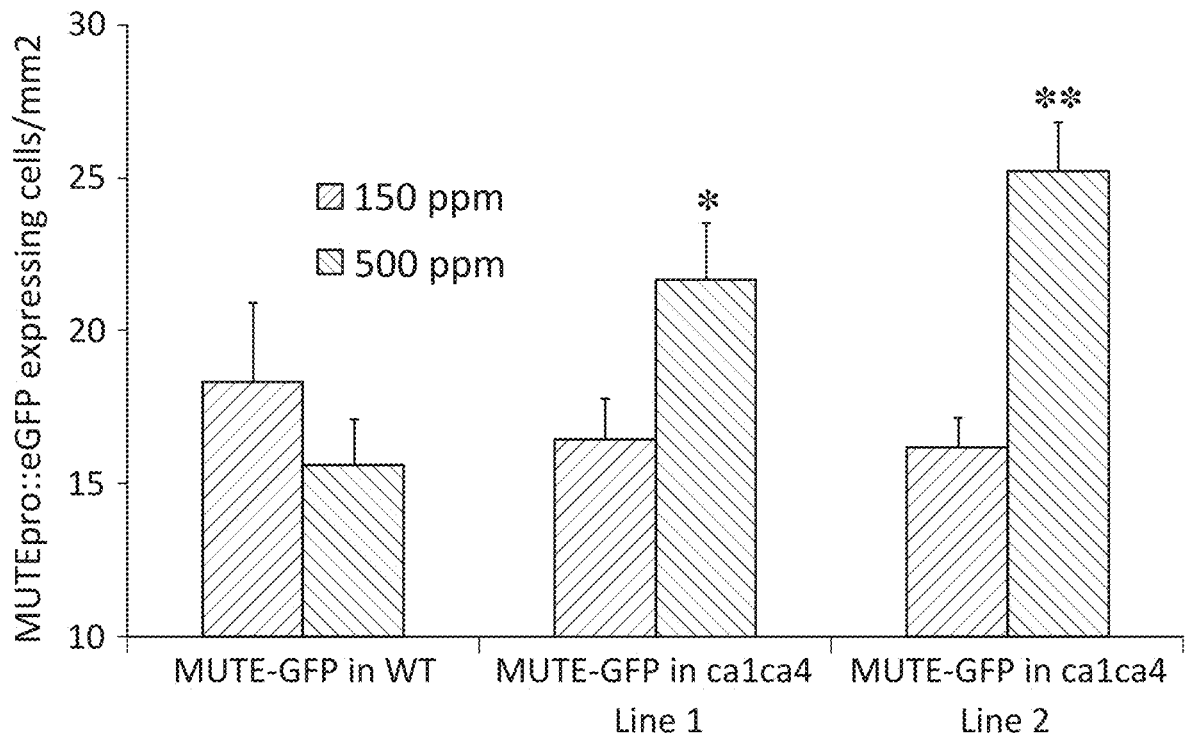
Figure 20E:
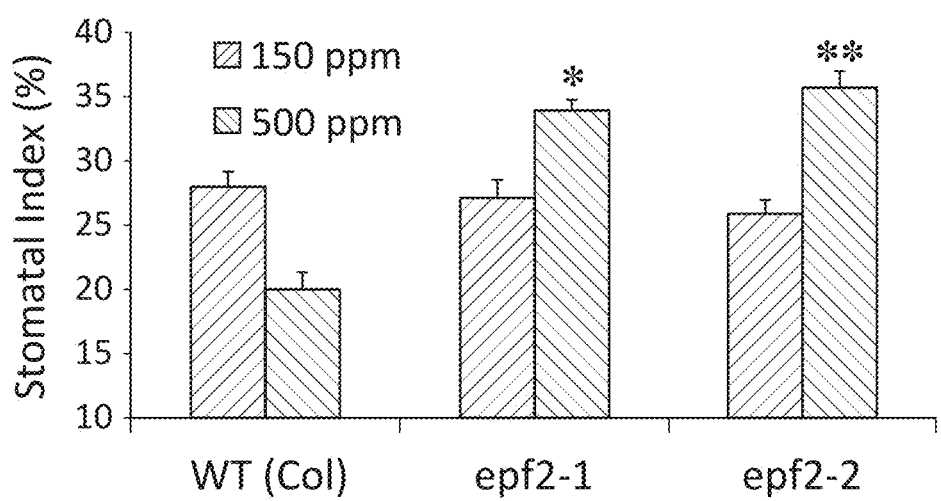

In order to gain insight into the developmental stage(s) at which βCA1 and βCA4 mediate $CO_2$ control of stomatal development, we tested the effects of preferential expression of these native *Arabidopsis* carbonic anhydrases in mature guard cells[6,21], as YFP fusion proteins (FIG. 19 *a, b, c*, or FIG. 2*a-c* of Example 3). These cell-type specific complementation analyses showed that the enhanced stomatal development at elevated $CO_2$ in the ca1ca4 mutant can be suppressed by preferential expression of either CA1 or CA4 in mature guard cells (FIG. 19 *b, c, d*, or FIG. 2*b-d* of Example 3). This result provides initial evidence for a non-cell autonomous character of $CO_2$ signaling mediated by these carbonic anhydrases during protodermal cell fate specification in developing cotyledons.

We next interrogated whether carbonic anhydrase enzyme activity or the specific structure of βCA1 and βCA4 are important for mediating $CO_2$ control of stomatal development. We transformed the ca1ca4 mutant with the unrelated human α-CAII[6] as a YFP fusion protein under the control of the mature guard cell preferential promoter (pGC1; FIG. 19 *b, c*, or FIG. 2*b,c* of Example 3). Human αCAII has low protein sequence identity to the *Arabidopsis* βCA1 (9%) and (βCA4 (12%)[6] and as such, is an ideal candidate for these studies. In all three independent transformant lines tested, the elevated $CO_2$-induced inversion in stomatal index of ca1ca4 mutant plants was partially suppressed by mature guard cell-targeted expression of the human carbonic anhydrase gene (FIG. 19 *e*, or FIG. 2*e* of Example 3). This result suggests that catalytic activity of the carbonic anhydrases may be required for $CO_2$ control of stomatal development. Furthermore, these findings indicate that carbonic anhydrase activity in mature guard cells can function in the perception or initial signal relay of $CO_2$ and that the $CO_2$ signal can be transmitted non-cell autonomously from mature guard cells (FIG. 19 *b*, or FIG. 2*b* of Example 3) to developing protodermal cells (FIG. 19 *a, c*, or FIG. 2*a, c* of Example 3) to mediate $CO_2$ modulation of stomatal development.

Leaf transpiration rates control stomatal development[22]. As $CO_2$ levels affect transpiration by regulating stomatal movements[6,9,11], we examined whether the processes governing transpiration and $CO_2$-induced stomatal movements are distinct from $CO_2$ regulation of stomatal development. We chose the open stomata 1 (OST1) protein kinase gene mutant for these studies as OST1 is an upstream regulator of ABA-induced stomatal closure and mutations in this gene result in plants which show a higher transpiration rate[23]. Furthermore, OST1 is a key mediator of $CO_2$-induced stomatal closure downstream of carbonic anhydrases[24] and whether $CO_2$ control of stomatal development requires OST1 is unknown. Thus we investigated whether ost1-3 mutant plants also show an inversion of the $CO_2$-controlled stomatal development response. ost1-3 mutant plants grown at elevated $CO_2$ showed an average 7.3% reduction in stomatal index (FIG. 2f of Example 3). Furthermore, ost1-3 mutant leaves had slightly larger average stomatal indices (FIG. 2f of Example 3) compared to wildtype leaves at low and elevated $CO_2$ (FIG. 2f, P=0.097 at 150 ppm). Hence we conclude that disrupted stomatal movements and increased transpiration in the ost1 mutants do not cause the $CO_2$-induced inverted stomatal development response. These findings show a divergence point in the $CO_2$ signaling pathways controlling stomatal movements and stomatal development.

To gain initial insight into the regulatory mechanisms through which elevated $CO_2$ signaling exerts non-cell autonomous repression of stomatal development, we conducted high throughput RNA-Seq transcriptomics on immature *Arabidopsis* seedlings grown at low and elevated $CO_2$. These analyses and independent single gene qPCR studies of developing cotyledons show a $CO_2$-induced upregulation of EPF2[7,8] transcripts in the wildtype and a dramatic downregulation in the ca1ca4 mutant (FIG. 3a of Example 3). Our mature guard cell complementation analyses support a role for cell-cell signaling in elevated $CO_2$-mediated repression of stomatal development (FIG. 2 of Example 3). The secreted EPF signaling pro-peptides have been identified as extracellular pro-peptide ligands that mediate cell-cell control of stomatal development[7,8,13].

EPF2 is an early mediator of protodermal cell fate specification and controls cell entry into the stomatal lineage by limiting asymmetric divisions[7,8]. MUTE[14,15] expression is a reliable indicator of cells entering the stomatal lineage because it is also induced early and specifically during meristemoid differentiation[16,17]. We transformed and examined wildtype and ca1ca4 mutant plants harboring a MUTEpro::nucGFP construct[14,15]. Compared to wildtype, ca1ca4 plants expressed MUTEpro::GFP in 33% more cells, on average, at elevated $CO_2$ but not at low $CO_2$ (FIG. 3b-d). The MUTEpro::nucGFP expression correlates with the increased stomatal index found at elevated $CO_2$ in ca1ca4 mutant leaves (FIG. 1c of Example 3) and suggests that the increased stomatal development at elevated $CO_2$ in ca1ca4 plants progresses via components upstream of MUTE. These data correlate with our observations of EPF2 gene expression in response to $CO_2$ elevation.

We analyzed whether genetic perturbation of EPF2 would result in an abnormal stomatal development response to $CO_2$ concentration, or [$CO_2$]. Two independent single mutant alleles tested for epf1 show a clear inversion in $CO_2$ control of stomatal development (FIG. 3e) with an average of 23.4% (FIG. 3e of Example 3) more stomata at elevated $CO_2$, when compared to plants grown at low $CO_2$. Conversely, the epf1-1 mutant, which acts further downstream in stomatal development[13], does not show an inversion of the $CO_2$-controlled stomatal development response to elevated $CO_2$ (Supplemental FIG. 1a of Example 3). Mutation of a related negative regulatory secreted peptide, challah[25], also did not invert the $CO_2$-controlled developmental response (Supplemental FIG. 1b of Example 3). These findings strongly suggest that CA1 and CA4 control $CO_2$ regulation of EPF2 expression and that EPF2 is a key transducer of elevated $CO_2$-exerted repression of stomatal development in the protoderm.

EPF2 belongs to a family of 11 EPF and EPFL peptide proteins, which are predicted to have a cleavage site, which upon cleavage converts the pro-peptide into an active peptide ligand isoform[16,17,26]. Hence we tested a mutant in the SDD1 gene, which has been shown to be a negative regulator of stomatal development and which encodes an extracellular subtilisin-like serine protease[20]. The stomatal index of the sdd1-1 mutant is much higher than the corresponding C24 wildtype accession (FIG. 4a). The sdd1-1 mutant shows, on average, a 4.2% decrease in stomatal index at elevated $CO_2$, similar to the wildtype C24 background line (FIG. 4a of Example 3). This result indicates that the SDD1 protease is not involved in $CO_2$ control of stomatal development, consistent with studies suggesting that SDD1 does not function in the same pathway as EPF2[7,8] and that extracellular proteases that function in the EPF1, EPF2 and STOMAGEN pathways remain unknown.

We hypothesized that there may be a distinct extracellular protease(s) which mediates $CO_2$ control of stomatal development. SDD1 belongs to a wider, 56 member subtilisin-like serine protease family (subtilases). We pursued proteomic analyses of apoplastic proteins in leaves and identified a subtilisin-like serine protease, SBT5.2 (FIG. 4b and Supplemental FIG. 2 of Example 3), which is distantly related to SDD1. Interestingly, qPCR data of developing cotyledons show a dramatic increase in SBT5.2 transcript in the wildtype at elevated $CO_2$ (FIG. 4c of Example 3). In contrast, the ca1ca4 mutant fails to show this increase in SBT5.2 transcript and instead shows a downregulation of SBT5.2 at elevated $CO_2$ (FIG. 4c), similar to $CO_2$ regulation of EPF2 expression (FIG. 3a of Example 3). We named this protease (SBT5.2) CRSP for $CO_2$ Responsive Secreted Protease. We tested two T-DNA insertion alleles (FIG. 4d and Supplemental FIG. 3 of Example 3) for $CO_2$ control of stomatal development for this extracellular protease. Interestingly, the two distinct crsp mutant alleles (Supplemental FIG. 3 of Example 3) show a deregulation of stomatal development, with more stomata at elevated $CO_2$ than at low $CO_2$ (FIG. 4d of Example 3).

To determine whether the EPF2 pro-peptide can be cleaved by CRSP, we constructed a synthetic peptide spanning the predicted EPF2 cleavage site and subjected this peptide (synEPF2) to in vitro proteolysis analyses using CRSP synthesized in vitro (wheat germ extract system). The synEPF2 peptide is flanked by fluorophore and quencher moieties and fluorescence can be measured when the quencher-fluorophore interaction is disrupted by cleavage of synEPF2. The CRSP protease shows robust cleavage of synEPF2 in vitro and this cleavage is abolished by the inclusion of protease inhibitors in the reaction (FIG. 4e of Example 3). Presently, no environmental signals are known that mediate control of stomatal development via the extracellular pro-peptides EPF1, EPF2, and STOMAGEN or the SDD1 protease. Together, these findings point to the extracellular protease CRSP, identified here as a mediator of the $CO_2$-controlled stomatal development response and further suggest the exciting possibility that proper activity of the negative regulator EPF2 depends on CRSP function.

Atmospheric [$CO_2$] elevation causes a repression of stomatal development in plants. This causes leaf temperature to rise due to a decrease in the plant's evapotranspirative cooling ability, while simultaneously increasing the transpiration efficiency of plants[19]. These phenomena, combined with the increasing scarcity of fresh water for agriculture are predicted to dramatically impact plant health[11,27-29]. We have uncovered key elements in a long-sought pathway by which elevated $CO_2$ controls cell fate and stomatal development in plants[4]. The results of our studies identify three new key players in $CO_2$ control of stomatal development: βCA1/βCA4, CRSP and EPF2.

The present data point to a pathway and framework for $CO_2$ control of stomatal development in which the β-carbonic anhydrases CA1 and CA4 function non-cell autonomously in catalytically transducing the elevated [$CO_2$] signal. $CO_2$ elevation induces EPF2 and CRSP mRNAs in wildtype, but not in ca1ca4 mutant leaves (FIGS. 3a and 4c of Example 3). We have identified an extracellular protease, CRSP, which is essential for $CO_2$-induced repression of stomatal development. EPF2 peptides are predicted to be activated by cleavage, thus signaling repression of stomatal development[16,17,26], but not by the SDD1 protease[7,8]. CRSP can cleave EPF2 and our data indicate that CRSP could activate EPF2 to mediate repression of stomatal development upon an elevated $CO_2$ stimulus. In the absence of the elevated $CO_2$-mediated induction of Crsp and Epf2, competing extracellular signals that promote stomatal development, in particular the STOMAGEN peptide[18,19,29], may partially contribute to the inverted $CO_2$ control of stomatal development found here for the ca1ca4, epf1 and crsp mutants (FIGS. 1, 3 and 4). The mechanisms reported here can also aid towards understanding natural variation in stomatal developmental responses to elevated $CO_2$ in *Arabidopsis* and other plant species[30]. As plants grow and respond globally to the continuing rise in atmospheric $CO_2$ levels, an understanding of the key genetic players that mediate the $CO_2$-controlled plant developmental response is critical for agriculturally relevant efforts aimed at ameliorating water use efficiency or heat resistance of plants.

Methods

Plant Growth and Image Analysis.

Wildtype (Columbia, C24 and Ler accessions) and individual mutant seedlings were grown in Percival plant growth chambers under identical conditions of light, humidity and temperature with only $CO_2$ concentration being varied (Low=100 ppm or Elevated=500 ppm). T-DNA insertion alleles used were: SALK_132812C=crsp-1, SALK_099861C=crsp-2, SALK_102777=epf2-1, GK-673E01=epf2-2. In previous transformant analyses of ca1ca4, YFP fusions of carbonic anhydrases were not used[6], whereas here YFP fusions were used to ascertain developmental stage-dependent expression of CAs. Seedlings were grown for 10 days at which point, abaxial epidermal surfaces of mature cotyledons from 10 independent seedlings were imaged using propidium iodide staining and a confocal microscope (two non-overlapping images per cotyledon for a total n=20 per genotype per $CO_2$ treatment). Images were acquired from the center of the cotyledon, away from the margin and midrib. Epidermal cells were counted and stomatal density and index (Stomatal density=number of stomata per $mm^2$; Stomatal Index=Percentage of epidermal cells which are stomata; S.I.=100*[Number of stomata]/ [Number of stomata+Number of pavement cells]) was quantitated using Image J. Note that absolute stomatal indices and the degree of change in indices varied slightly from experiment to experiment, similar to previous studies[5]. Additionally, as multiple environmental stimuli can influence stomatal development and control baseline stomatal density or indices can vary slightly from experiment to experiment, for all experiments, wildtype controls were grown side-by-side and data from within each experiment were analyzed with the corresponding mutants. Furthermore, all experiments were repeated at least three times and blind experiments were conducted in which either the genotype, or both the genotype and $CO_2$ concentration (double blind) were unknown to the experimenter until after data quantitation was completed for all types of experiments.

Statistical Analyses.

In all figures, statistical comparisons were conducted using the OriginPro 8.6 software package for individual genotypes between $CO_2$ treatments or compared to the WT or the ca1ca4 mutant data using ANOVA and the Tukey post test. *=P<0.00005, =P<0.005, *=P<0.05. For all figures: n=20 images were analyzed per genotype and $CO_2$ treatment; error bars indicate standard error.

qPCR Analyses.

qPCR experiments were conducted on cDNA synthesized from total RNA extracted from 500 pooled seedlings from the different $CO_2$ treatments 5 DAG. Three biological repeats were conducted and candidate gene expression was normalized to the CLATHRIN gene. Primer sequences used for qPCR were as follows: EPF2.For: CGCCGCGTGT-TCTTTGGTCG (SEQ ID NO:123), EPF2.Rev: CGGCGTTTTTCTTTTCTCCGCCA (SEQ ID NO:124), CLATHRIN.For: ATACGCGCTGAGTTCCC (SEQ ID NO:125), CLATHRIN.Rev: CTGACTGGCCCTGCTT (SEQ ID NO:126), CRSP.For: ATGGCAGCTCCTCAT-GTTTCAGC (SEQ ID NO:127), CRSP.Rev: CGTTGTTT-GTTTGAGTCGCTGTTG (SEQ ID NO:128).

In Vitro Cleavage of Synthetic EPF2.

A 30 AA partial EPF2 peptide, which included the predicted cleavage site and was bracketed by fluorophore and quencher moieties was synthesized (LifeTein Inc.): Dabcyl-SKNGGVEMEMYPTGSSLPDCSYACGACSPC-Glu (EDANS) (SEQ ID NO:122). STREP II-tagged CRSP protease was synthesized using the TnT SP6 high yield wheat germ expression system (Promega) and purified using the STREP-TACTIN MACROPREP™ resin (IBA). 100 µl in vitro cleavage reactions in 1×PBS were incubated at 30° C. in a 96 well plate reader (Berthold Mithras LB 940) and fluorescence readings were acquired every 10 minutes after shaking the plate for 1 second. A final concentration of 30 µM synEPF2 and approximately 10 picomoles of CRSP protease were used in the reactions. Inclusion of 1:20 dilution of plant protease inhibitor cocktail (Sigma) and peptide or CRSP protease only were used as controls. Fluorescence data were normalized for background fluorescence using buffer only controls and change in relative fluorescence was calculated by subtracting the initial fluorescence measurement for each sample. Mean values are shown (n=2) and error bars represent standard deviation. In independent experiments under different concentrations of protease (20 picomoles) and synEPF2 (50 µNI), similar results were obtained (n=2).

Apoplastic Peptide Isolation.

Rosettes of 10 soil grown plants (8 weeks old) were vacuum-infiltrate with 0.3M Mannitol for 2 minutes at room temperature, after which leaves were spun at 200 g in a swinging bucket rotor at 4° C. for 15 minutes. The same leaves were re-infiltrated with 0.2M $CaCl_2$ in 0.3M Mannitol for 3 minutes under vacuum at room temperature after which leaves were spun at 200×g in a swinging bucket rotor at 4° C. for 20 minutes. The spinning produced 19 mL of apoplastic fluid which was run through an Amicon Ultra-15 filter column (15 mL capacity) in a swinging bucket rotor at 4100 rpms and 4° C. Flowthrough was run through the column 3 times to obtain a final volume of 300 µL in the filter cup. 30 μL of Protease inhibitor cocktail (Sigma) was added to the 300 μL protein sample. The 300 μL of protein solution was acidified with 1% TFA to a final concentration of 0.1% TFA. Millipore ZIPTIP™ pipette tips were used according to manufacturer's protocols and protein samples were eluted in an Acetonitrile dilution series as follows: 5, 10, 20, 30, 40, and 50% Acetonitrile in 0.1% TFA. The samples were desiccated and re-dissolved in 0.1% TFA and 5% acetonitrile. The peptides were then extracted and desalted using Aspire RP30 desalting columns (Thermo Scientific).

Sample Trypsinization.

As described previously[31]: Samples were diluted in THE (50 mM Tris pH 8.0, 100 mM NaCl, 1 mM EDTA) buffer. RAPIGEST™ SF reagent (Waters Corp.) was added to the mix to a final concentration of 0.1% and samples were boiled for 5 min. TCEP (Tris (2-carboxyethyl) phosphine) was added to a final concentration of 1 mM and the samples were incubated at 37° C. for 30 min. Next, the samples were carboxymethylated with 0.5 mg/ml of iodoacetamide for 30 min at 37° C. followed by neutralization with 2 mM TCEP (final concentration). The protein samples prepared above were digested with trypsin (trypsin:protein ratio=1:50) overnight at 37° C. RAPIGEST™ was degraded and removed by treating the samples with 250 mM HCl at 37° C. for 1 h followed by centrifugation at 15800 g for 30 min at 4° C. The soluble fraction was transferred to a new tube and the peptides were extracted and desalted using Aspire RP30 desalting columns (Thermo Scientific). Trypsin-digested peptides and directly extracted peptides were analyzed by high pressure liquid chromatography (HPLC) coupled with tandem mass spectroscopy (LC-MS/MS) using nano-spray ionization as described previously[32] with the following changes: The nanospray ionization experiments were performed using a QSTAR-Elite hybrid mass spectrometer (ABSCIEX) interfaced with nano-scale reversed-phase HPLC (Tempo) using a 10 cm-100 micron ID glass capillary packed with 5-μm C18 ZORBAX™ beads (Agilent Technologies, Santa Clara, Calif.). Peptides were eluted from the C18 column into the mass spectrometer using a linear gradient (5-60%) of ACN (Acetonitrile) at a flow rate of 400 0/min for 1 h. The buffers used to create the ACN gradient were: Buffer A (98% H2O, 2% ACN, 0.2% formic acid, and 0.005% TFA) and Buffer B (100% ACN, 0.2% formic acid, and 0.005% TFA). MS/MS data were acquired in a data-dependent manner in which the MS1 data was acquired from m/z of 400 to 1800 Da and the MS/MS data was acquired from m/z of 50 to 2,000 Da. MS/MS data were analyzed using PROTEIN PILOT 4.0™ (ABSCIEX) for peptide identification.

Figure Legends—See Description of Figures, Above

REFERENCES—EXAMPLE 3

1 Bergmann, D. C. & Sack, F. D. Stomatal Development. *Annual Review of Plant Biology* 58, 163-181 (2007).
2 Pillitteri, L. J. & Torii, K. U. Mechanisms of Stomatal Development. *Annu Rev Plant Biol* (2012).
3 Nadeau, J. A. & Sack, F. D. Control of stomatal distribution on the *Arabidopsis* leaf surface. *Science* 296, 1697-1700 (2002).
4 Woodward, F. I. Stomatal numbers are sensitive to increases in $CO_2$ from pre-industrial levels. *Nature* 327, 617-618 (1987).
5 Gray, J. E. et al. The HIC signalling pathway links $CO_2$ perception to stomatal development. *Nature* 408, 713-716 (2000).
6 Hu, H. et al. Carbonic anhydrases are upstream regulators of $CO_2$-controlled stomatal movements in guard cells. *Nat Cell Biol* 12, 87-93 (2010).
7 Hara, K. et al. Epidermal Cell Density is Autoregulated via a Secretory Peptide, EPIDERMAL PATTERNING FACTOR 2 in *Arabidopsis* Leaves. *Plant and Cell Physiology* 50, 1019-1031 (2009).
8 Hunt, L. & Gray, J. E. The signaling peptide EPF2 controls asymmetric cell divisions during stomatal development. *Curr Biol* 19, 864-869 (2009).
9 Kim, T. H., Bohmer, M., Hu, H., Nishimura, N. & Schroeder, J. I. Guard cell signal transduction network: advances in understanding abscisic acid, $CO_2$, and Ca2+ signaling. *Annu Rev Plant Biol* 61, 561-591, doi:10.1146/annurev-arplant-042809-112226 (2010).
10 Woodward, F. I. Potential impacts of global elevated CO(2) concentrations on plants. *Curr Opin Plant Biol* 5, 207-211 (2002).
11 Hetherington, A. M. & Woodward, F. I. The role of stomata in sensing and driving environmental change. *Nature* 424, 901-908 (2003).
12 Torii, K. U. et al. The *Arabidopsis ERECTA* gene encodes a putative receptor protein kinase with extracellular leucine-rich repeats. Plant Cell 8, 735-746 (1996).
13 Hara, K., Kajita, R., Torii, K. U., Bergmann, D. C. & Kakimoto, T. The secretory peptide gene EPF1 enforces the stomatal one-cell-spacing rule. *Genes Dev* 21, 1720-1725 (2007).
14 MacAlister, C. A., Ohashi-Ito, K. & Bergmann, D. C. Transcription factor control of asymmetric cell divisions that establish the stomatal lineage. *Nature* 445, 537-540 (2007).
15 Pillitteri, L. J., Sloan, D. B., Bogenschutz, N. L. & Tofii, K. U. Termination of asymmetric cell division and differentiation of stomata. *Nature* 445, 501-505 (2007).
16 Kondo, T. et al. Stomatal density is controlled by a mesophyll-derived signaling molecule. *Plant Cell Physiol* 51, 1-8 (2010).
17 Sugano, S. S. et al. Stomagen positively regulates stomatal density in *Arabidopsis*. *Nature* 463, 241-244 (2010).
18 Bergmann, D. C., Lukowitz, W. & Somerville, C. R. Stomatal development and pattern controlled by a MAPKK kinase. *Science* 304, 1494-1497 (2004).
19 Masle, J., Gilmore, S. R. & Farquhar, G. D. The ERECTA gene regulates plant transpiration efficiency in *Arabidopsis*. *Nature* 436, 866-870 (2005).
20 Berger, D. & Altmann, T. A subtilisin-like serine protease involved in the regulation of stomatal density and distribution in *Arabidopsis thaliana*. *Genes Dev* 14, 1119-1131 (2000).
21 Yang, Y., Costa, A., Leonhardt, N., Siegel, R. S. & Schroeder, J. I. Isolation of a strong *Arabidopsis* guard cell promoter and its potential role as a research tool. *Pl. Methods* 4, 1-15 (2008).
22 Lake, J. A. & Woodward, F. I. Response of stomatal numbers to $CO_2$ and humidity: control by transpiration rate and abscisic acid. New Phytol 179, 397-404 (2008).
23 Mustilli, A. C., Merlot, S., Vavasseur, A., Fenzi, F. & Giraudat, J. *Arabidopsis* OST1 protein kinase mediates the regulation of stomatal aperture by abscisic acid and acts upstream of reactive oxygen species production. *Plant Cell* 14, 3089-3099 (2002).
24 Xue, S. et al. Central functions of bicarbonate in S-type anion channel activation and OST1 protein kinase in $CO_2$ signal transduction in guard cell. *EMBO J* 30, 1645-1658 (2011).

25 Abrash, E. B. & Bergmann, D. C. Regional specification of stomatal production by the putative ligand CHALLAH. Development 137, 447-455 (2010).
26 Lee, J. S. et al. Direct interaction of ligand-receptor pairs specifying stomatal patterning. *Genes Dev* 26, 126-136 (2012).
27 Sellers, P. J. Modeling the exchanges of energy, water, and carbon between continents and the atmosphere. *Science* 275, 502-509 (1997).
28 LaDeau, S. L. & Clark, J. S. Rising $CO_2$ levels and the fecundity of forest trees. *Science* 292, 95-98 (2001).
29 Battisti, D. S. & Naylor, R. L. Historical warnings of future food insecurity with unprecedented seasonal heat. *Science* 323, 240-244 (2009).
30 Woodward, F. I., Lake, J. A. & Quick, W. P. Stomatal development and $CO_2$: ecological consequences. *New Phytologist* 153, 477-484 (2002).
31 Guttman, M. et al. Interactions of the NPXY microdomains of the low density lipoprotein receptor-related protein 1. *Proteomics* 9, 5016-5028 (2009).
32 McCormack, A. L. et al. Direct analysis and identification of proteins in mixtures by LC/MS/MS and database searching at the low-femtomole level. *Anal Chem* 69, 767-776 (1997).

Example 4: Characterization of the Genes, Mechanisms and Pathways that Mediate Elevated $CO_2$ Control, or Repression, of Stomatal Development This example presents describes and presents data characterizing the genes, mechanisms and pathway that mediate, or control, elevated $CO_2$ repression of stomatal development.

Figure 25:
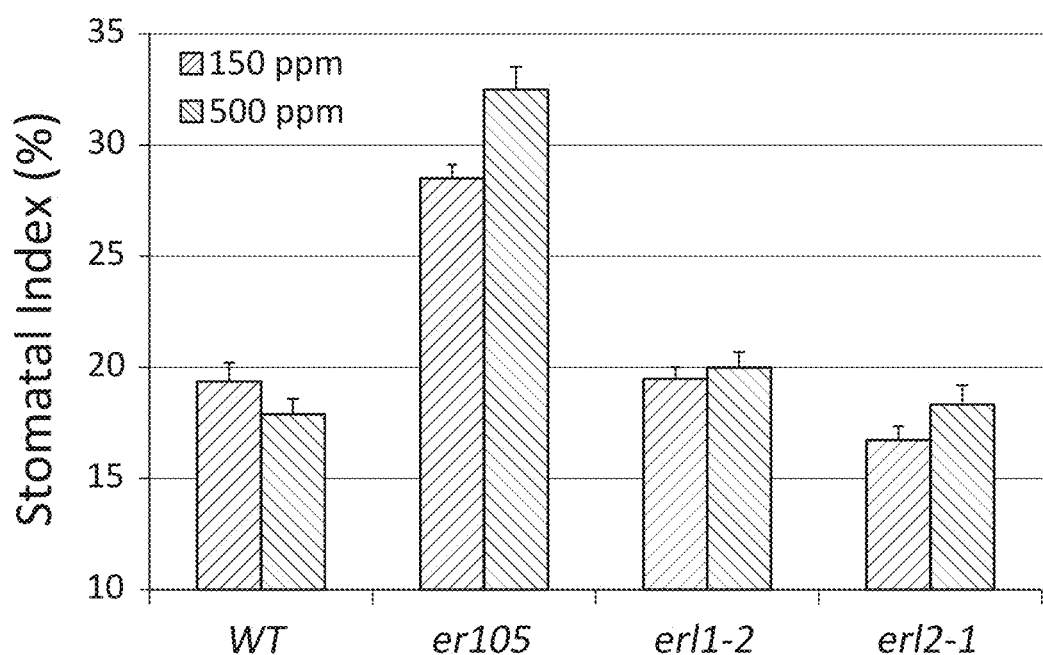
FIG. 25: Graphically illustrates abaxial stomatal indices (i.e. the percent of epidermal cells which are stomata) for mature cotyledons (10 days after germination) of Columbia (WT) and the erl05, erl1-2, and erl2-1 single mutants grown at low (150 ppm; blue) and high (500 ppm; red) $CO_2$, as described in detail in Example 4, below.
Figure 26:
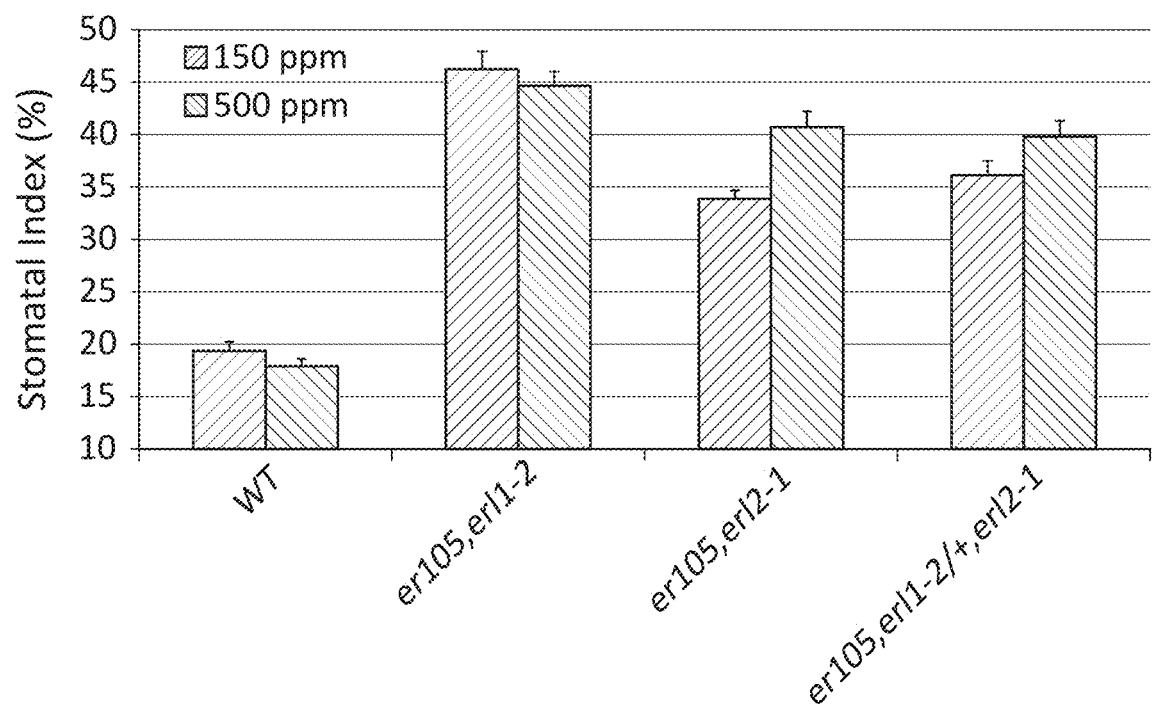
FIG. 26: Graphically illustrates abaxial stomatal indices (i.e. the percent of epidermal cells which are stomata) for mature cotyledons (10 days after germination) of Columbia (WT) and the erl05,erl1-2, and erl05,erl2-1 double mutants and the erl05,erl1-2/+,erl2-1 triple mutant grown at low (150 ppm; blue) and high (500 ppm; red) $CO_2$, as described in detail in Example 4, below.

$CO_2$ Control of Stomatal Development for the *Erecta* Single and Double Mutants:

In order to isolate downstream components of the signaling pro-peptide EPF2 and the subtilisin-like secreted protease CRSP, we tested whether the ERECTA transmembrane receptor(-like) kinases might be involved in this pathway. Double blinded experiments reveal that the *erecta* single mutant (erl05; in Columbia ecotype) also shows a robust de-regulation of $CO_2$-controlled suppression of stomatal development. The erl1-2 and the erl2-1 single mutants show a slight inverted effect, which is not as strong as the ERECTA mutant phenotype (FIG. 25). This result is important for our work on identifying all major components in the $CO_2$-controlled stomatal development pathway and fits well with work which suggests that ERECTA and EPF2 form ligand-receptors pairs. When ERECTA (erl05) and *ERECTA*-like1 and 2 (erl1 erl2) mutants are combined into double mutant background lines, the inverted $CO_2$ control of stomatal development phenotype is again clearly visible, but is not significantly enhanced compared to the erl05 single mutant (FIG. 26). The erl05,erl2-1 double mutant combination shows the strongest inversion among the double mutants (FIG. 26). These studies are being repeated and tested further to resolve the key mediators downstream of CRSP and EPF2 in the $CO_2$ signaling in the pathway.

Figure 21A:
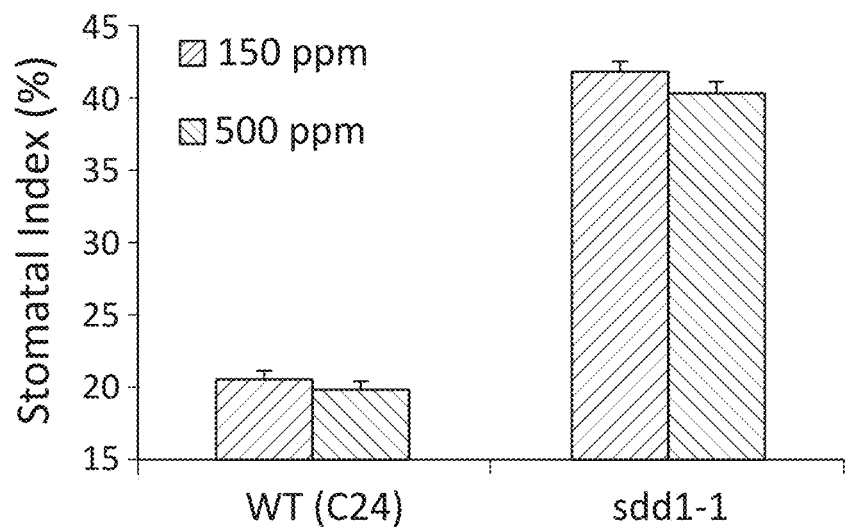
Figure 21C:
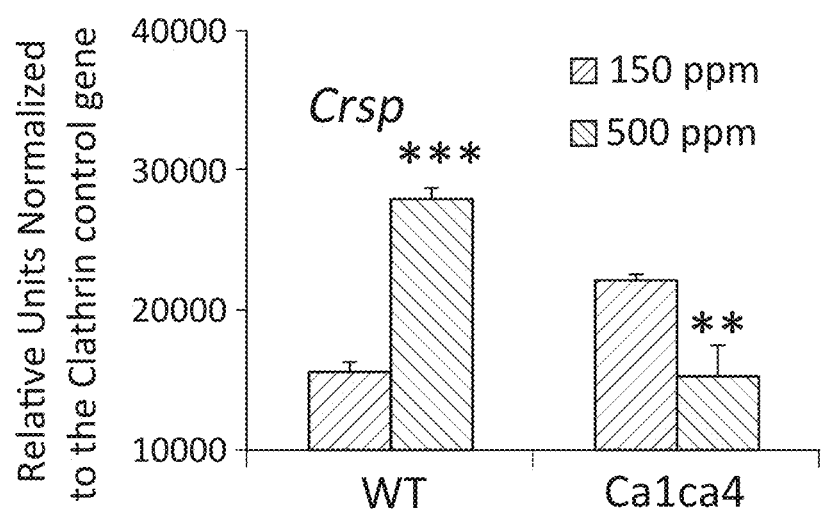
Figure 21B:
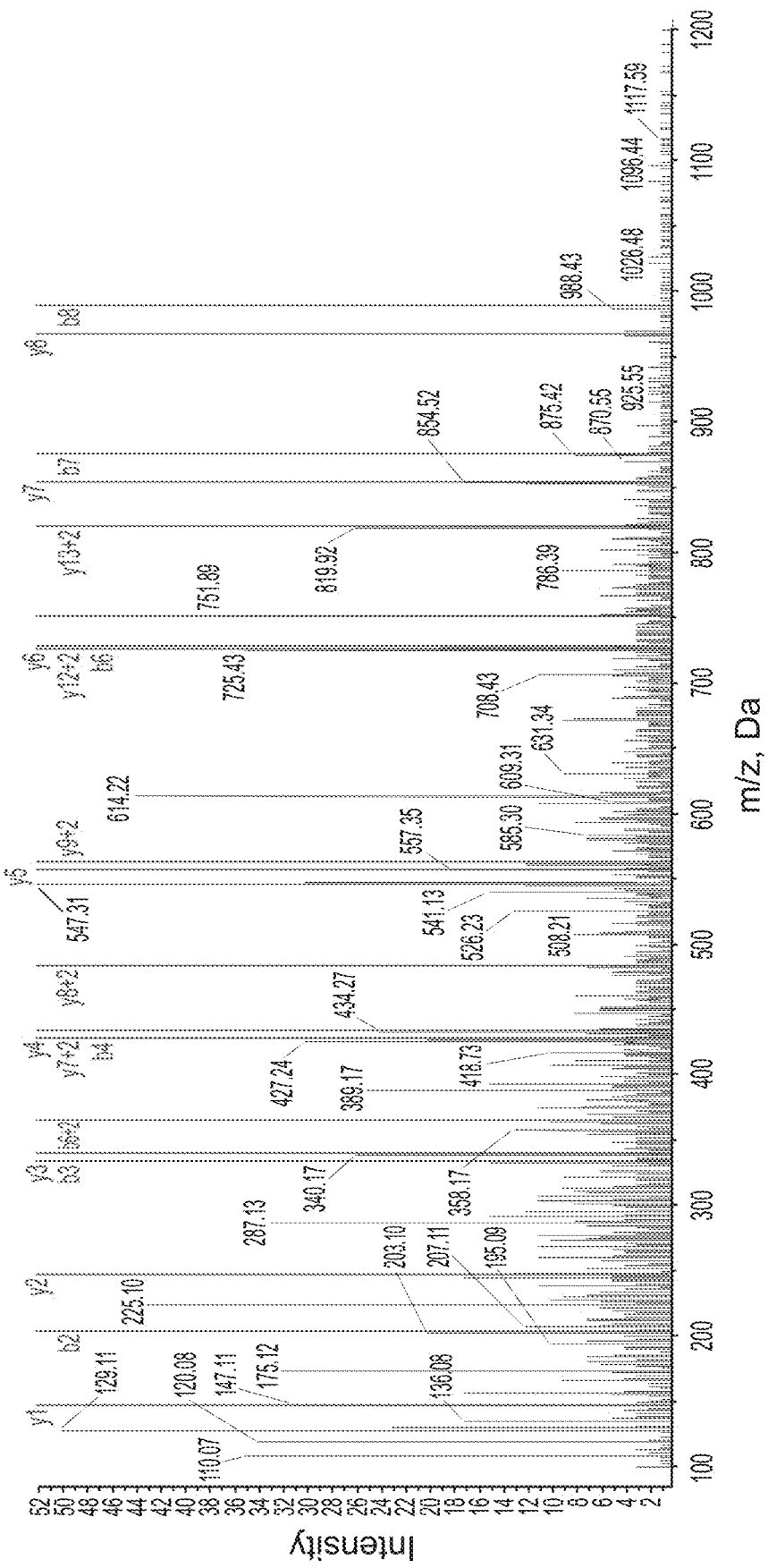
Figure 21D:
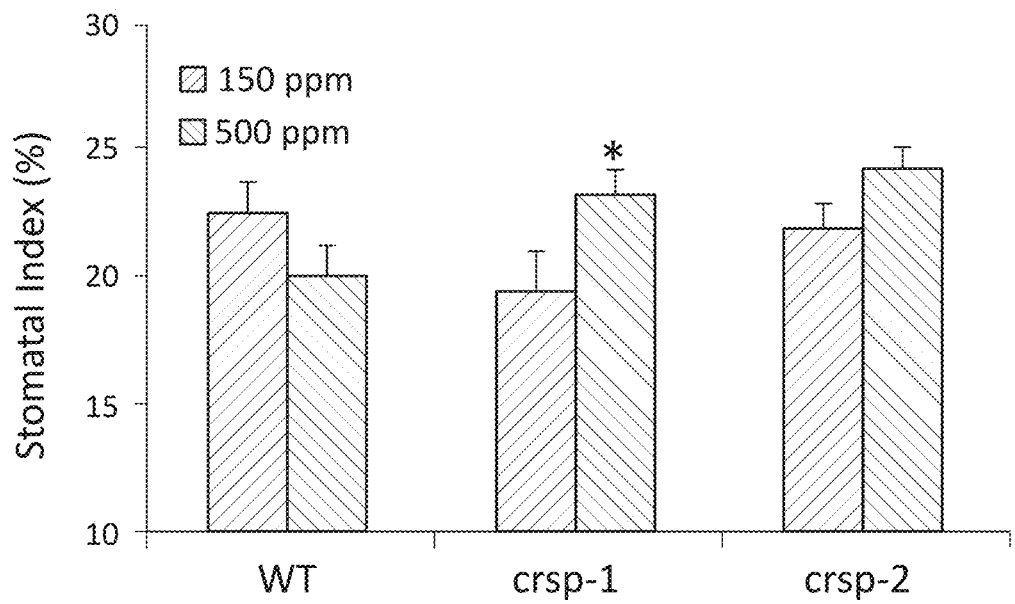
Figure 21E:
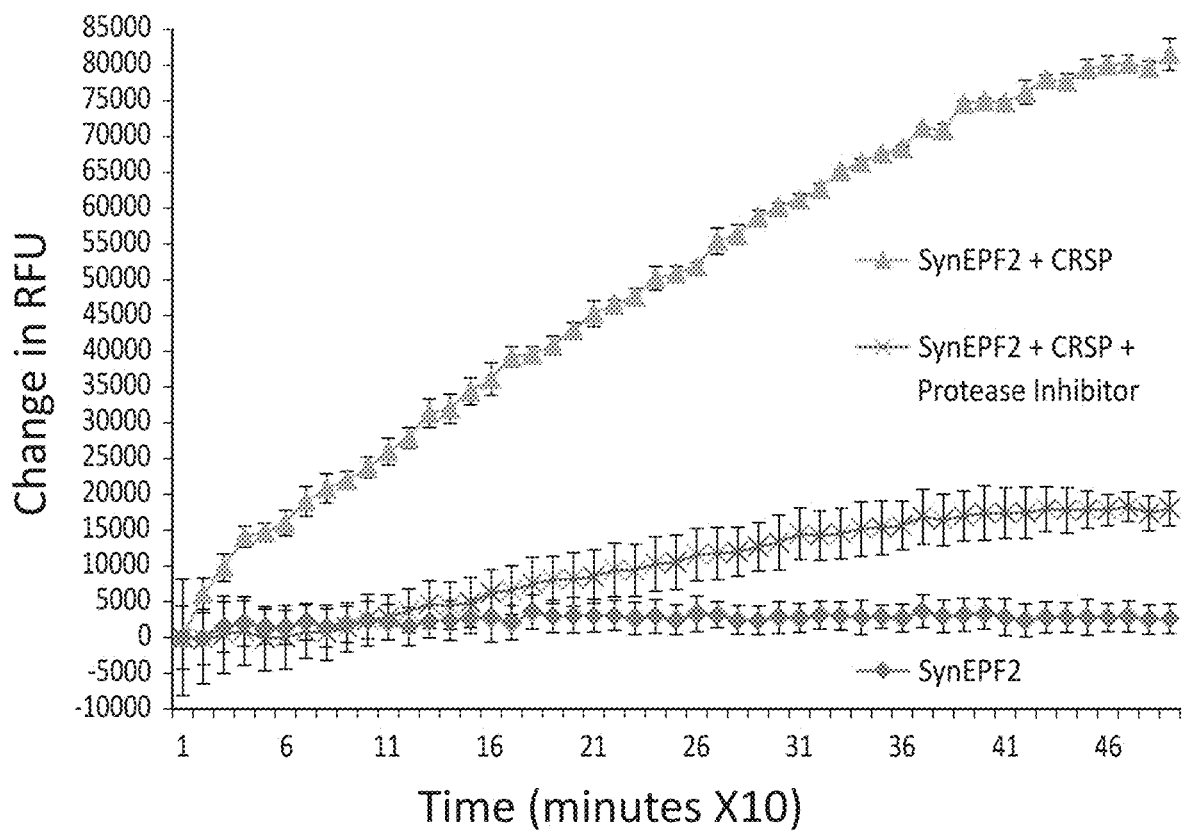
Figure 22A:
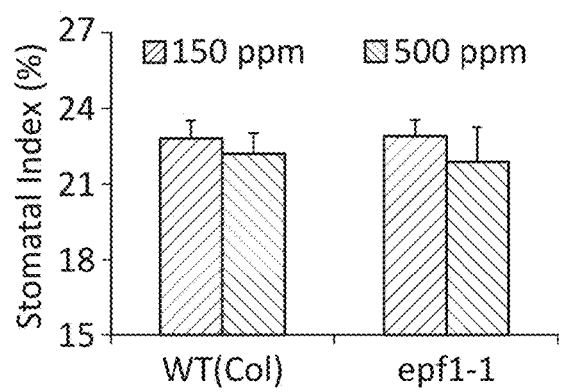
FIG. 22, or Supplemental FIG. 2 of Example 3|Mutations in negative regulatory extracellular signals of stomatal development, EPF1 and CHALLAH do not exhibit inverted $CO_2$ control of stomatal development. a-b, Stomatal index of 10-day-old WT Columbia, (a) the epf1-1 single mutant, and (b) the challah[25] single mutant seedlings grown at low (150 ppm) and elevated (500 ppm) $CO_2$ concentrations. Two images from each of 10 individual seedlings were captured on a confocal microscope for a total of 20 images analyzed per genotype per $CO_2$ treatment. Mean values+standard error are shown. Three biological repeats were conducted. Further described in Example 3, below.
Figure 22B:
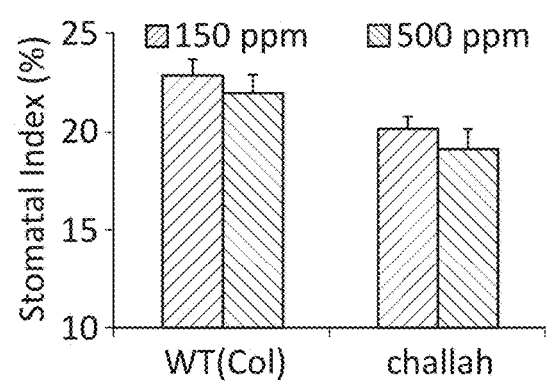
Figure 23A:
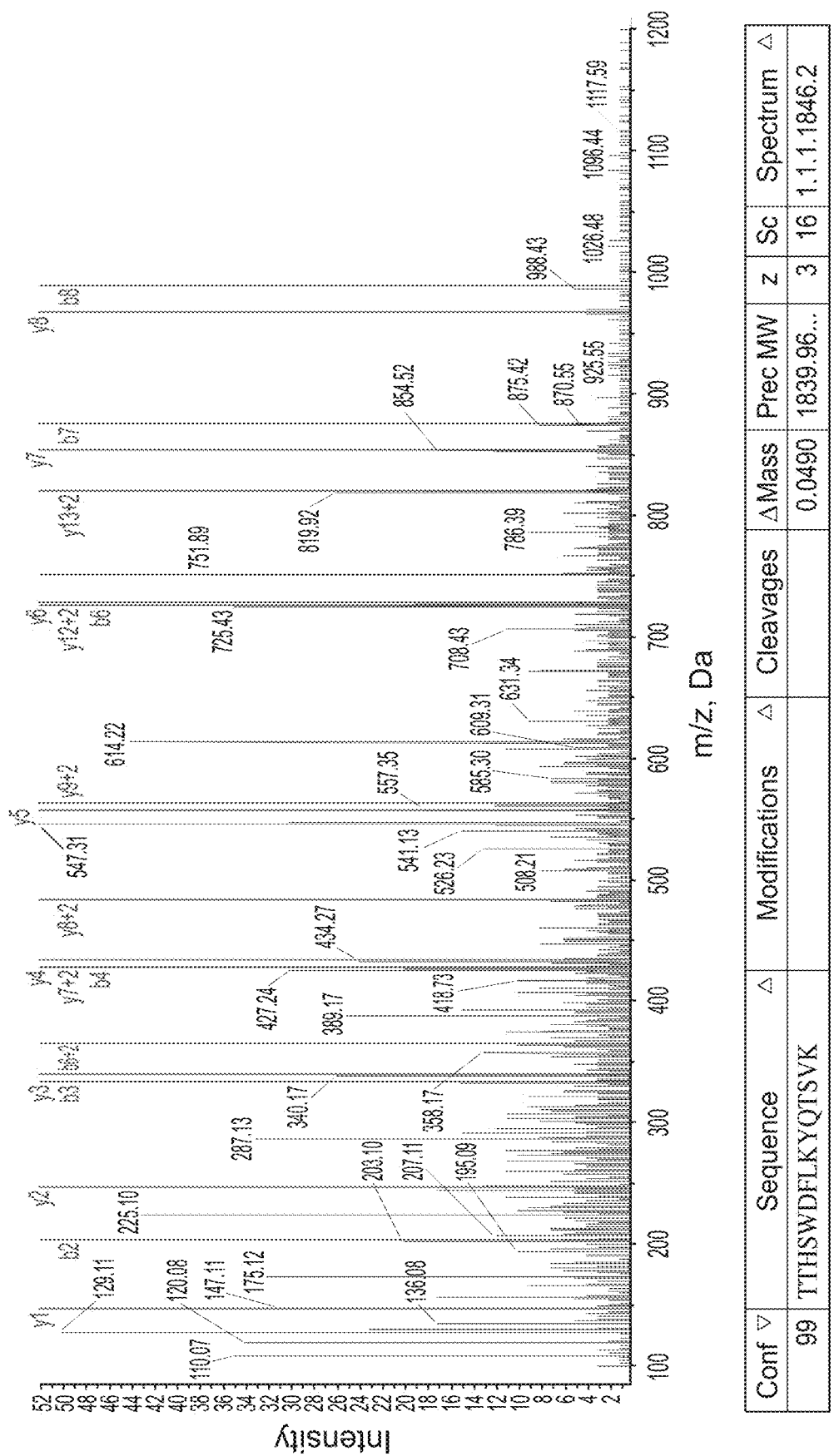
FIG. 23, or Supplemental FIG. 2 of Example 3| Tandem mass spectrometry (MS/MS) spectra identifying CRSP protease in the apoplast proteome. a, Product ion spectrum for the native peptide TTHSWDFLKYQTSVK (SEQ ID NO:132) of ($CO_2$-regulated secreted subtilisin-like serine protease (CRSP) recovered directly from the apoplast extract before trypsin digestion. Product ion spectrum for the parent ion of m/z=614.33 (+3) is shown. Apoplastic proteins were isolated, purified and subjected to MS/MS as described in the Supplemental Methods. b, Product ion spectrum for the peptide AVASAYGSFPTTVIDSK (SEQ ID NO:133) of CRSP identified from trypsin digestion of the apoplast extract. Product ion spectrum for the parent ion of m/z=857.44 (+2) is shown. The product ion spectra are annotated for y, y+2, b, and b+2, using the paragon algorithm (PROTEINPILOT 4.0 ABSCIEX™). Tables show the identification results for the peptides using PROTEIN-PILOT 4.0. CONF.™ denotes the percent confidence (99%) score for the identified peptide. Cleavages=any potential mis-cleavage. Delta Mass=theoretical mass–measured mass. Z=charge state. Further described in Example 3, below.
Figure 23B:
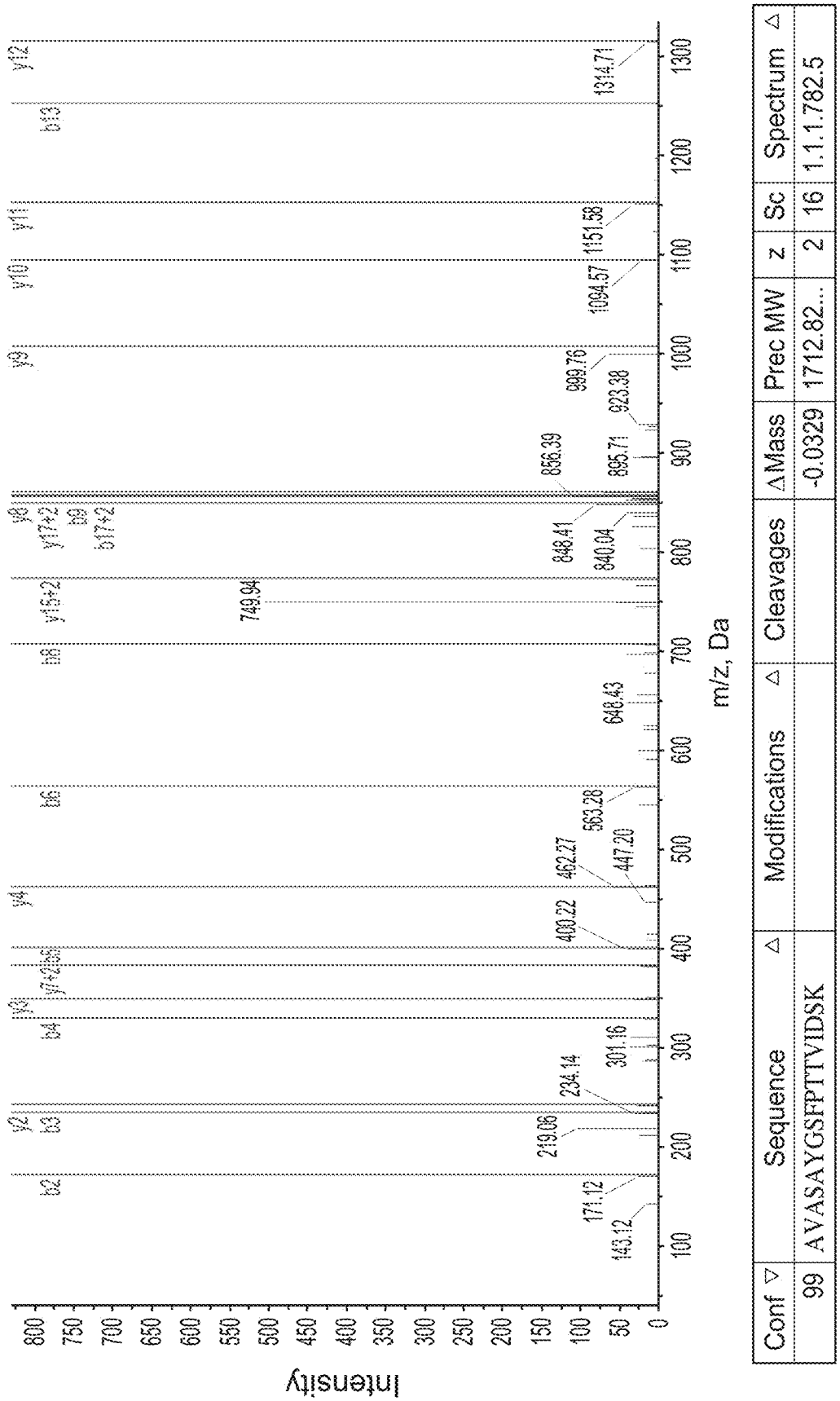
Figure 24:
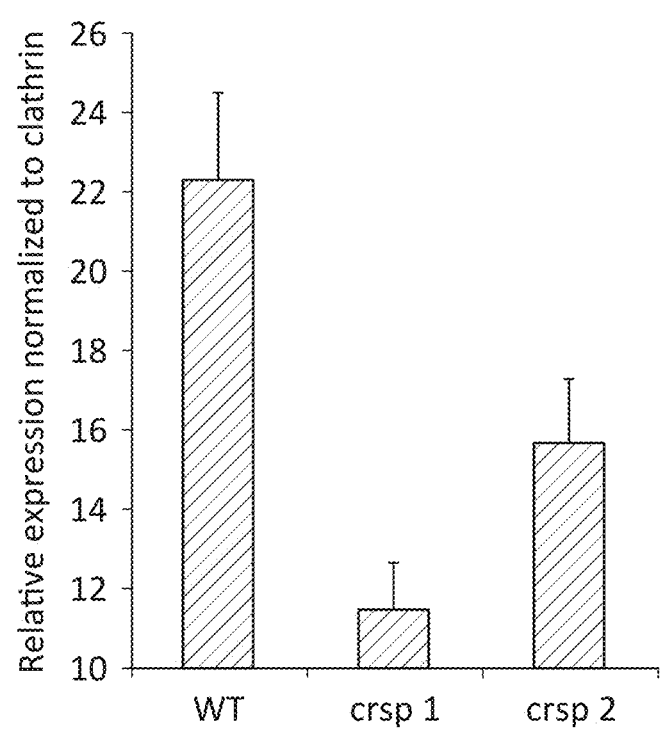
FIG. 24, or Supplemental FIG. 3 of Example 3|qPCR for T-DNA insertion alleles in CRSP. qPCR analyses for 10-day-old seedlings were conducted for WT, crsp-1 (SALK_132812C) and crsp-2 (SALK_099861C). 20 seedlings were pooled and RNA isolated for cDNA synthesis and subsequent qPCR. Expression levels were normalized to the CLATHRIN gene. qPCR results suggest a strong reduction in CRSP transcript in the crsp-1 mutant allele. The crsp-2 mutant has a T-DNA insertion at the 3' end of the last ($9^{th}$) exon and shows partially reduced CRSP transcript level. For primer sequences see Methods. Further described in Example 3, below.
Figure 27:
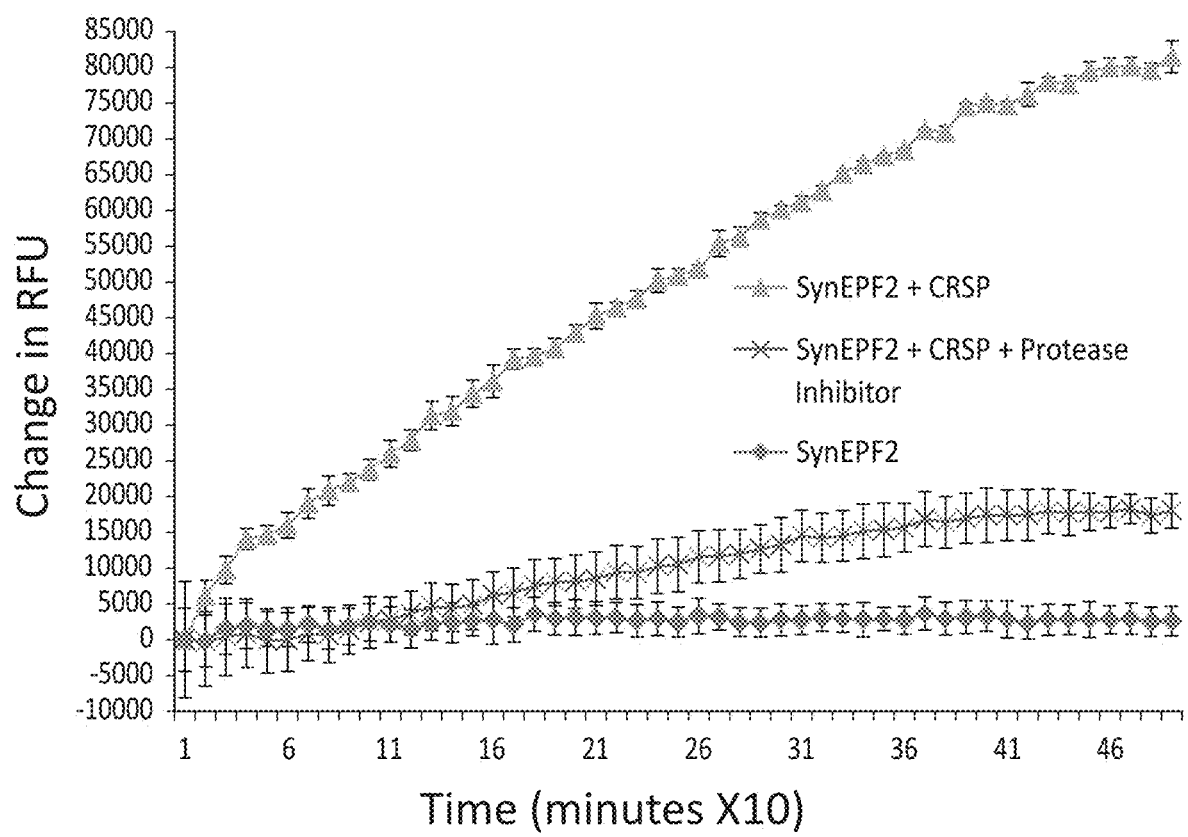
FIG. 27: Graphically illustrates: In vitro cleavage over time (×10 minutes) of synthetic EPF2 peptide by ($CO_2$-regulated secreted subtilisin-like serine protease (CRSP) (see Table 1 for EPF2 sequence and fluorescent tag information). Change in relative fluorescence emitted over time upon cleavage of synthetic EPF2 peptide (synEPF2) by the CRSP protease in the presence or absence of protease inhibitors, as described in detail in Example 4, below.

Cleavage Site Determination of Synthetic Fluorogenic EPF Peptides Processed by CRSP and SDD1 Proteases:

A conclusion is that the CRSP protease processes EPF2. To directly test this we employed a synthetic peptide and protease fluorogenic assay approach (FIG. 27; see FIG. 21e, or FIG. 4e of Example 3). Initial analyses indicate that EPF1 cleavage by both SDD1 and CRSP shows low affinity. This suggests that EPF1 cleavage by these proteases might be random and non-specific over the length of the peptide sequence. EPF2 cleavage sample traces indicate that EPF2 cleavage by CRSP could be specific (compared with SDD1); we are conducting detailed tandem mass spectrometry analyses of these reactions.

To improve this protocol, we did shorter cleavage reactions for 10 minutes, rather than the 6 hour incubations that were done in previous experiments. Longer incubations might allow less specific, slower reactions to also progress.

We employed the high yield SP6-TNT-wheat germ system to synthesize STREPII™ tagged CRSP and SDD1 (control) proteases. The IBA-Streptactin system was used to purify the STREPII™ tagged proteases, which were used in the cleavage reactions. Controls included the wheat germ system alone with a negative water template control. Four synthetic fluorogenic substrates were used: EPF1, EPF2, EPF2-long and STOMAGEN as follows:

TABLE 1

Synthetic peptide sequences along with attached fluorescent moieties.

| PEPTIDE NAME | SEQUENCE |
| --- | --- |
| STOMAGEN | Dabcyl-LLPQVHLLNSRRRHMIGSTAPTCTYNECRG-Glu-EDANS, N-terminal Dabcyl and C-terminal Glu-EDANS (SEQ ID NO: 119) |
| EPF2-Long | Dabcyl-HKKEISKNGGVEMEMYPTGSSLPDCSYACGACSPCKRVMISFECSVAESCSVIYRCTCRGRYYHVPSRA-HHHHHH-Glu-EDANS, 75aa, N-terminal Dabcyl and C-terminal Glu-EDANS (SEQ ID NO: 120) |
| EPF1 | Dabcyl-KRQRRRPDTVQVAGSRLPDCSHACGSCSPC-Glu-(EDANS) (SEQ ID NO: 121) |
| EPF2 | Dabcyl-SKNGGVEMEMYPTGSSLPDCSYACGACSPC-Glu-(EDANS) (SEQ ID NO: 122) |

*Cleavage is "predicted" to occur between the red AAs for EPF1 and EPF2 and confirmed for STOMAGEN.

Figure 28:
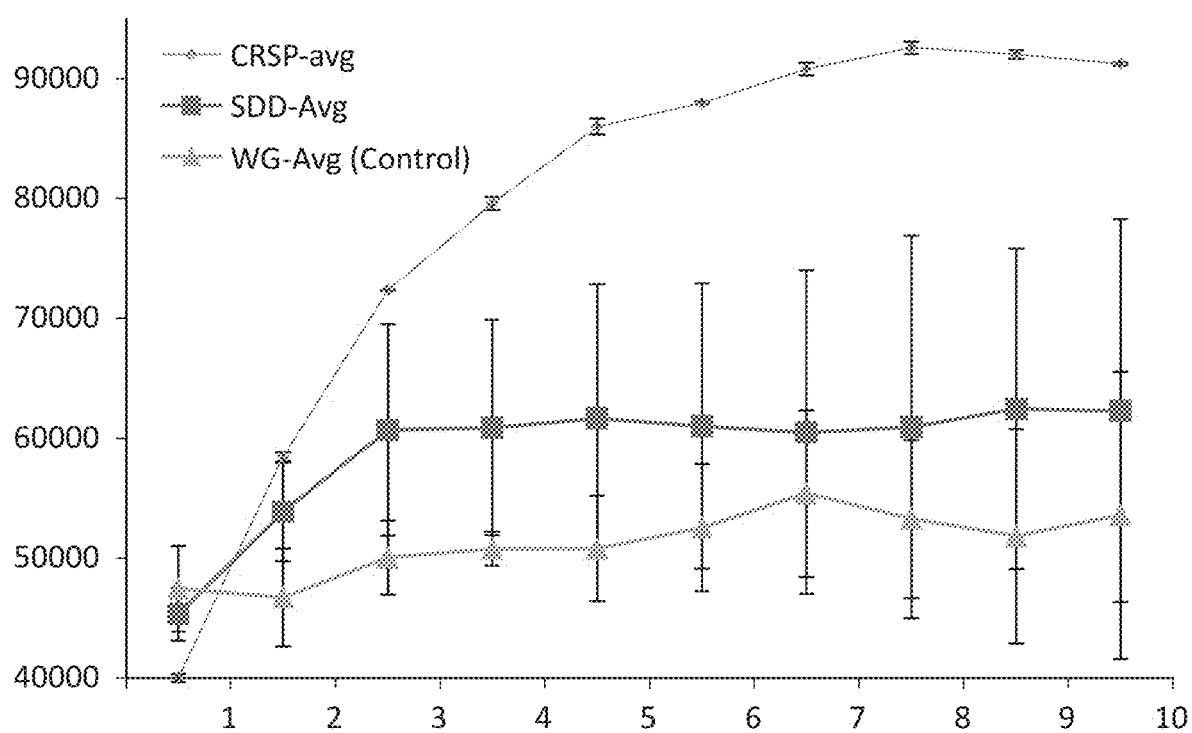
FIG. 28: Graphically illustrates preliminary data from ongoing in vitro cleavage experiments over time (×10 minutes) of synthetic EPF2-Long peptide (Table 1 for sequence and fluorescent tag information) by the ($CO_2$-regulated secreted subtilisin-like serine protease (CRSP) and SDD1 proteases and negative control (WG; Wheat Germ extract). Increase in fluorescence is indicative of peptide cleavage over time, as described in detail in Example 4, below.
Figure 29:
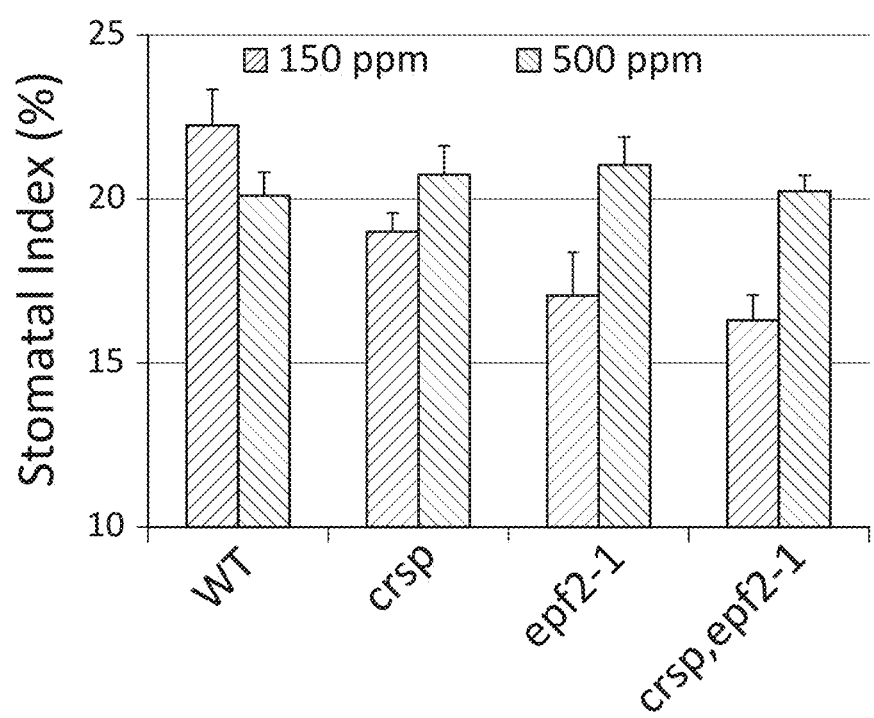
FIG. 29: Graphically illustrates abaxial stomatal indices (i.e. the percent of epidermal cells which are stomata) for mature cotyledons (10 days after germination) of Columbia (WT) and the crsp and epf2-1 single mutants, and the crsp,epf2-1 double mutant plants grown at low (150 ppm; blue) and high (500 ppm; red) $CO_2$, as described in detail in Example 4, below.

While EPF1 and STOMAGEN in the above table are negative controls, the EFP2-Long peptide was designed with future in planta experiments in mind which would test the bioactivity of this synthetic peptide in planta. A sample trace of the EPF2-Long peptide cleavage by CRSP, SDD1 and negative control (WG) is shown in FIG. 28. We are currently using mass spectroscopy analyses of the in vitro cleavage reactions to determine cleavage specificity for peptide-protease pairs. We are further improving and testing this method to gain insight into the precise cleavage site necessary for EPF2 processing and bioactivity in planta.

Proteomic Studies for Apoplast of Whole Mature Leaves for WT, Crsp and the Ca124 Mutants:

We have undertaken several approaches to identify apoplast and cell wall-associated protein mediators of CO2 signaling. Our first set of data identified 688 proteins in the apoplast of WT and ca124 mutant leaves. These experiments were performed on whole rosettes of mature plants grown in bulk on soil. We repeated this experiment and the second set of mature plants grown at low and elevated CO2 for apoplast proteomics was harvested and analyzed at the UCSD proteomics core facility. However, there was a problem with the polyvinylpyrrolidone, which was used to remove phenolics and MS traces were poor. Hence, we employed a new approach with vacuum infiltration of excised leaves with extraction buffer followed by a short spin and Amicon column size exclusion. Mesophyll contamination was monitored by chlorophyll content of the centrifugate. This new technique was used for 20 mature leaves from WT, crsp-1 and ca124 plants. MS analysis at the UCSD proteomics core facility of this small batch of proteins gave over 200 independent hits including the CRSP protease (re-confirming our previous identification of CRSP). This new approach can be used for deeper identification of proteins present in the apoplast and for candidates whose abundance or post-translational modification status changes upon $CO_2$ stress in the WT and ca124 mutant plants.

Invertase Hits in Apoplast Proteomic Studies:

We identified INVERTASES in apoplast samples. Table 2 below lists 3 invertase proteins and their spectral counts in our samples.

TABLE 2

INVERTASE identification in apoplast proteomes of WT, ca124 and crsp mutant leaves.

| Identified Invertase Proteins | Accession Number | Molecular Weight | Total spectral counts in our samples |
|---|---|---|---|
| Plant invertase/pectin methylesterase inhibitor superfamily | AT2G45220.1 | 56 kDa | 210 |
| Plant invertase/pectin methylesterase inhibitor superfamily | AT2G26440.1 | 60 kDa | 28 |
| Plant invertase/pectin methylesterase inhibitor superfamily | AT5G62350.1 | 22 kDa | 9 |

Epistasis Analyses for Combinations of Epf2, Crsp and Ca124 Mutants:

An important question for the in planta evidence of EFP2 processing by CRSP is whether CRSP is in the same pathway as EPF2. We crossed the epf2-1 and epf2-2 mutants independently with crsp single mutants and have confirmed homozygous progeny for both allele combinations: i.e. epf2-1,crsp and epf2-2,crsp. Both sets of seeds for these lines were tested for $CO_2$ control of stomatal development and initial experiments indicate that the inverted $CO_2$ control of stomatal development phenotype appears not to be additive in the double mutants when compared to the single mutants (FIG. 5). This experiment can be repeated several times in independent double blind assays. We have also crossed the epf2-2,crsp-2 and ca1ca2ca4 mutants and have confirmed heterozygous F1 plants which have all 5 mutations and 4 mutations: either epf2-2 and ca1ca2ca4 or crsp-2, ca1, ca2 and ca4. Crosses for crsp-4 and crsp-1 alleles with epf2-2 have also been completed and F1 progeny isolation is next.

CRSP Expression Pattern and Localization Analyses in Planta:

We generated a CRSPpromoter::GUS plasmid and have transformed it into WT and ca124 plants. Positive transformants were selected for both sets of lines and seeds have been bulked. GUS studies on plants can be conducted next for detailed CRSP localization. We are also constructed a CRSPprom::CRSP-YFP fusion for more in depth cellular localization studies and functional complementation of the crsp mutant phenotype.

Figure 30:
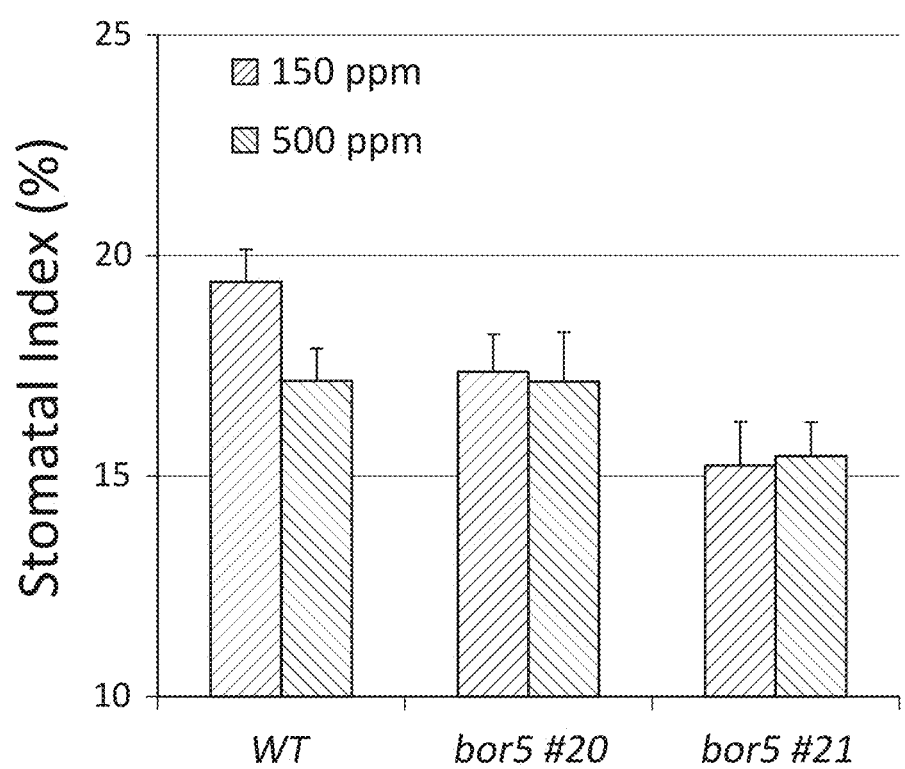
FIG. 30: Graphically illustrates abaxial stomatal indices (i.e. the percent of epidermal cells which are stomata) for mature cotyledons (10 days after germination) of Columbia (WT) and the bor5 mutant alleles (#20 and #21) grown at low (150 ppm; blue) and high (500 ppm; red) $CO_2$, as described in detail in Example 4, below.

CO2 Control of Stomatal Development for the Putative Bicarbonate Transporter:

BOR5: Our bioinformatic analyses showed that the BOR5 protein, which is a member of the boron transporter family has a bicarbonate transporter domain. Double-blinded experiments indicate that the bor5 single mutant alleles (#20=GK-703F07.01 and #21=GK-786H06) do not show a robust de-regulation (i.e. inversion of the WT response) in $CO_2$-controlled suppression of stomatal development (FIG. 30).

Germplasm: ABA and $CO_2$ Responsive Trait "Stacking" Lines in *Arabidopsis*:

We are combining ABA and $CO_2$ stomatal response traits to potentially enhance plant water use efficiency and drought resilience. Transformant lines can be genotyped (e.g., positive) for isolating single locus-single insert transgenic lines which can be used in our drought analyses. In order to achieve this goal, 100 individual T2 seedlings from 10 independent positive transformants each of the abi1-2, abi2-2 double and the abi1-2, hab1-1, pp2ca-1 triple mutants transformed with the pGC1::CA1 construct were grown for cRT-PCR analyses. From these 2000 initial plants, seeds and leaf tissue were individually collected for 445 plants for transgene insert number verification.

Gas Exchange and Targeting Studies for Carbonic Anhydrase:

We are targeting the carbonic anhydrase CA1 to the guard cell plasma membrane and CA4 to the chloroplast of ca1ca4 double mutant plants to determine whether the function of carbonic anhydrases (CAs) is directly related to their localization in guard cells. We conducted experiments with CA4, which is normally localized at the plasma membrane. We fused the 55 amino acids of the CplscA protein, a chloroplast transit sequence, to the N-terminus of CA4-YFP and the construct was transformed into the ca1ca4 double mutant. A strong YFP signal in chloroplasts was observed in transgenic plants, indicating that CA4 was successfully targeted to chloroplasts. Then we analyzed the $CO_2$ responses in these YFP expressing lines. Interestingly, the chloroplast expressing CA4-YFP did not clearly or completely complement the $CO_2$ insensitive phenotype of ca1ca4, as illustrated in FIG. 31.

Our previous tandem mass spectrometry data have shown that 107 amino acids of the N terminus of CA I is removed in planta, which is consistent with the model that beta-CAs are post-translationally modified in this fashion. We transformed the construct to enable plasma membrane targeting of CA1 by fusing a 12 amino acid N-terminal myristoylation domain of the plasma membrane-targeted AtCBL1 protein with CA1-YFP after the deletion of the first 107 AA of CA1. ca1ca4 mutant plants were transformed with this construct under the control of the guard cell promoter pGC1. T1 transgenic plants were screened by confocal microscopy to analyze YFP signals, but we could not observe YFP signals in several hundred lines. In our experience, transformation of T-DNA lines can often lead to limited expression of proteins based on previous experience, and thus many lines need to be screened to select expressing transformants in some cases. Then we screened for YFP signal in guard cells of the T2 generation of transgenic ca1ca4 plants, and we identified some very weak YFP expression at the plasma membrane. The $CO_2$ responses of these lines can be analyzed for $CO_2$ regulation of stomatal conductance using a LiCOR gas exchange analyzer to test whether a plasma membrane-localized CA1 can complement the $CO_2$ insensitivity of ca1ca4 plants.

Analyses of Type 2C Protein Phosphatases CPP2Cs) in $CO_2$-Induced Stomatal Closure:

The role of Type 2C protein phosphatases (PP2Cs) in $CO_2$-induced stomatal closure was not yet clarified in our previous analyses. Therefore we also analyzed $CO_2$ regulation of gas exchange in both Col- and Ler-based dominant mutant PP2C abi1-1 and abi2-1 lines in intact leaves. We found that the abi1-1 and abi2-1 mutants in the Col ecotype showed slightly impaired responses to changes of [$CO_2$] compared with Col-0 wild type plants and the abi1-1 and abi2-1 in Ler background showed a partial impairment in responses to $CO_2$ changes, suggesting that the dominant abi1-1 and abi2-1 PP2C phosphatase proteins show a conditional or partial effects on $CO_2$ responses.

Figure 32:
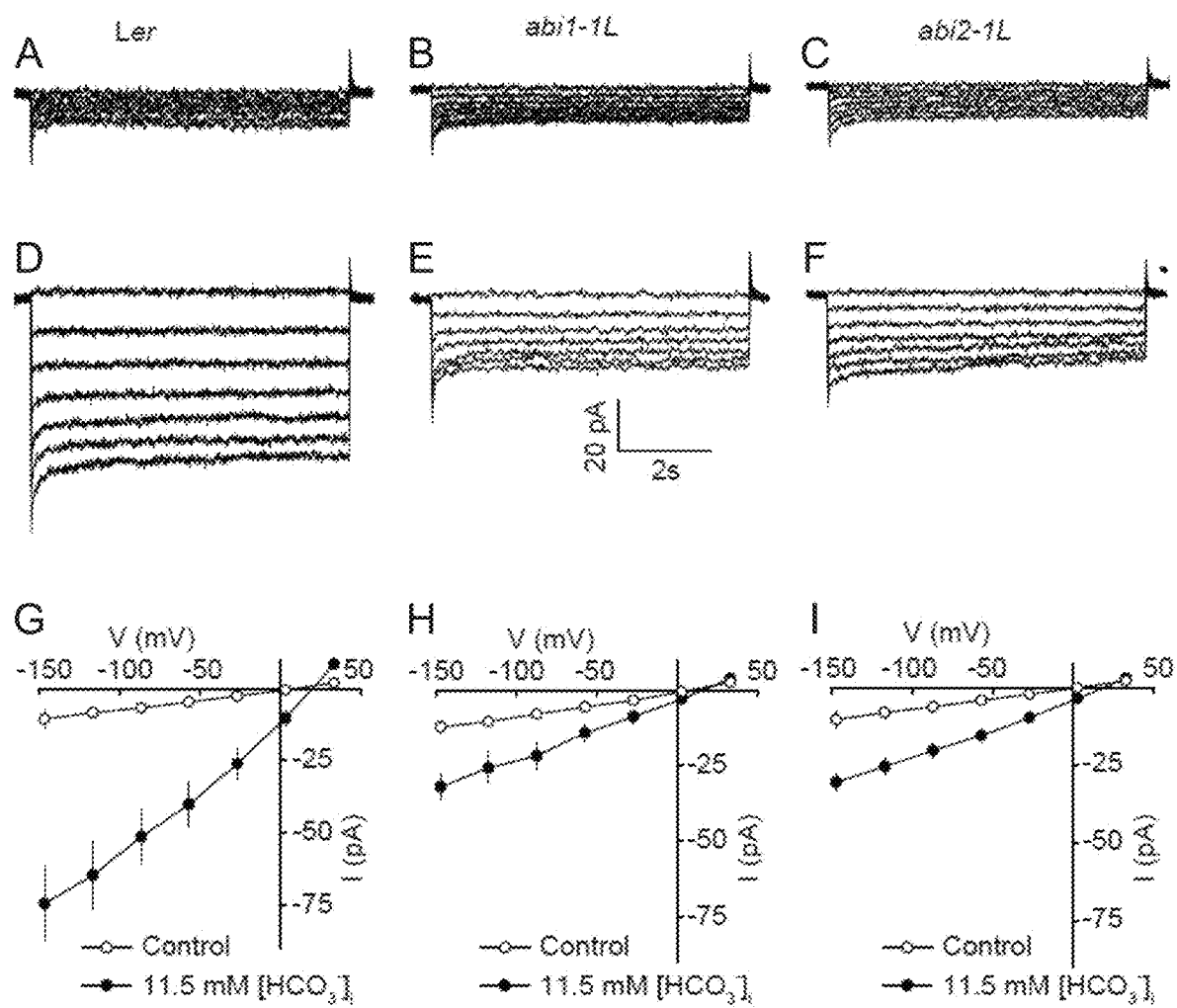
FIG. 32. Graphically illustrates bicarbonate-induced activation of S-type anion channels is reduced in both abi1-1L and abi2-1L guard cell protoplasts (L=Landsberg er accession). (A, B, C) Typical whole-cell recording without bicarbonate and (D, E, F) with elevated free bicarbonate added to the pipette solution in guard cell protoplasts of Ler wild type and abi1-1L and abi2-1L. Average steady-state current-voltage relationships for Ler (open circles, n=6; filled circles, n=7), abi1-1L (open circles, n=6; filled circles, n=7) and abi2-1L (open circles, n=5; filled circles, n=8) guard cell protoplasts are shown in (G), (H) and (I), respectively, as described in detail in Example 4, below.
Figure 33:
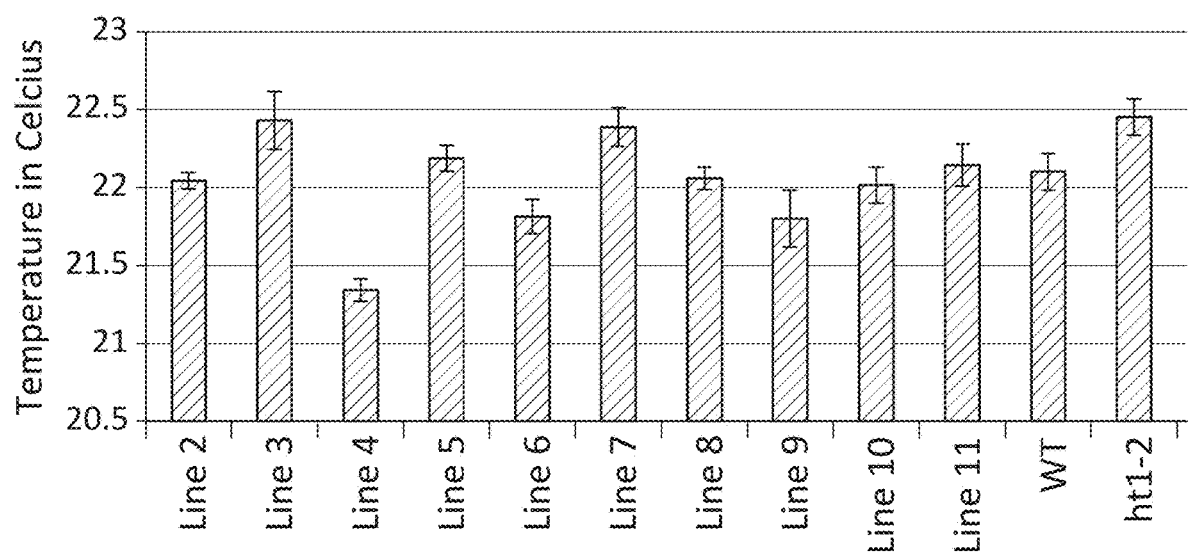
FIG. 33: Graphically illustrates validation of previously isolated activation tagging screen candidates exhibiting strong suppressor and enhancer phenotypes of the ca124 mutant cool leaf temperature. Thermal imaging data for 10 individual plants per line followed over the course of 8 weeks. 7 sets of independent thermal images were acquired over the course of 8 weeks. The high temperature ht1-2 mutant was included as a control, as described in detail in Example 4, below.

Recent research showed that β-carbonic acid anhydrases function early in $CO_2$-induced stomatal closure (Hu et al., 2010) and that bicarbonate ($HCO_3$.) is an important intracellular signal that triggers the activation of S-type anion channels in *Arabidopsis* guard cells (Xue et al., 2011). To further address the role of ABI1 and ABI2 in $CO_2$-induced stomatal signaling, $HCO_3$.-induced activation of S-type anion currents was measured in abi1-1 and abi2-1 in the Ler background plants. Here we used the same concentration of intracellular bicarbonate as that was used in Xue et al (Xue et al., 2011). Guard cell protoplasts from abi1-1 and abi2-1 displayed clearly reduced but still functional $HCO_3$.-induced activation of anion currents, as illustrated in FIG. 32.

The above results may be expected since the dominant mutations in these two PP2Cs (ABI1 and ABI2) are expected to down-regulate OST1 protein kinase activity, which does function in CO2 regulation of gas exchange. To further investigate whether these PP2Cs function in CO2 signaling of stomatal movements, we analyzed quadruple knockout mutant plants in four functional guard cell PP2Cs (ABI1, ABI2, PP2CA and HAB1). PP2C quadruple mutant plants, in which four PP2Cs were knocked out, exhibited closer to wild type-like $CO_2$ responses, indicating that PP2Cs may affect the CO2 response more indirectly compared to the OST1 protein kinase.

Together these results suggest that CO2 may not directly modulate these PP2Cs, but as these PP2Cs do interact with the OST1 protein kinase, they may exert mild or indirect effects on the CO2 response. These results further suggest that these protein phosphatases may not be ideal targets for modulation of CO2 responses, while they are good targets for modulating ABA responses and for "pyramiding" (stacking) experiments in which we are enhancing ABA-drought signaling and $CO_2$ signaling in the same plants (see above "Germplasm: ABA and $CO_2$ responsive trait "Stacking" lines in *Arabidopsis*").

High Throughput Leads for New Candidate Gene Capture in $CO_2$ Sensing and Signaling Cascades:

RNA-Seq for Columbia WT and ca1ca4 Mutant Seedlings Grown Under High and Low CO2 at Different Timepoints:

Previously, we have reported on RNA-Seq analyses for WT and ca1ca4 seedlings at 5 days after germination, see also Example 3, above. We analyzed two new RNA-Seq experiments for WT and ca1ca4 seedlings at 7 and 11 days after germination. Data were obtained at the BIOGEM, UCSD sequencing facility and we now have several significantly differentially expressed (up- and down-regulated) candidate hits for WT and the ca1ca4 mutant seedling samples. For these studies, we submitted 5 micro grams of total RNA per sample. The sequence coverage and % Mapping Efficiencies were excellent for all samples with >96.3% Mapping Efficiencies (i.e. the sample to the reference genome mapping efficiency, 95% or above is excellent). Also, very few genes (<128) showed a false discovery rate (FDR) beyond the acceptable threshold.

Proteomic Profiling of Columbia WT and ca1ca4 Mutant Seedlings Grown Under High and Low CO2:

Based on the best time-point determined by RNA-Seq, whole seedling proteomics (entire hypocotyls and cotyledons can be used for protein extraction) of WT and ca1ca4 seedlings can be conducted using a new protocol to increase protein coverage (ultracentrifugation to separate microsomes from cytosolic proteins). Tissue samples for 3 independent sets of seedlings can be prepared for protein purification and can be used once we determine the best RNA-Seq timepoint and what the subsequent proteomic sampling timepoint should be. The combined results from these studies and the above RNA-Seq experiments can be used to address our systems biology goals for network and hub identification for key mechanisms involved in $CO_2$ regulation of gas exchange in plants.

Figure 34A:
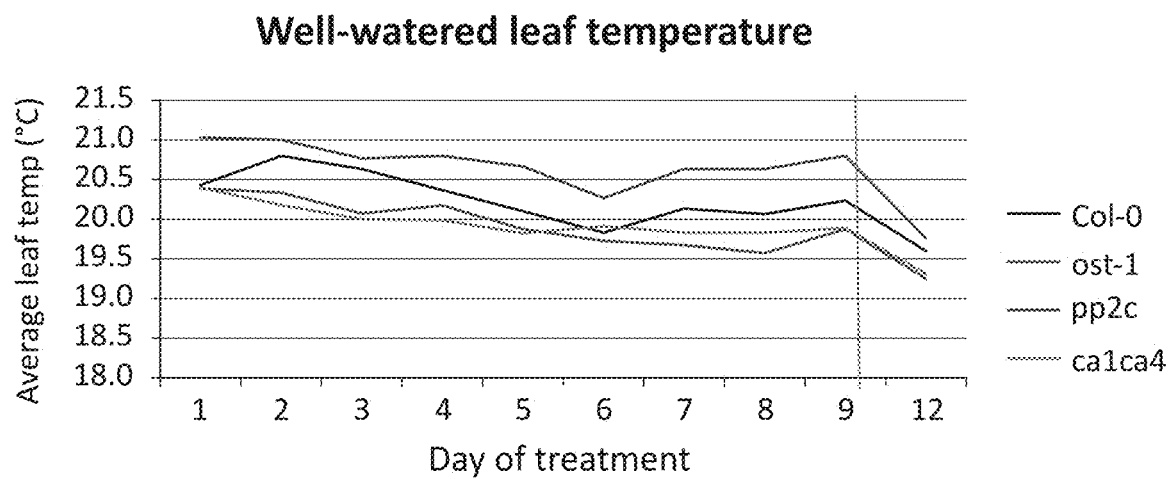
FIG. 34(a) well-watered; and, FIG. 34 (b) drought treated plants. Using an infrared thermal imaging camera, images of whole rosette per pot were taken daily, beginning 6 weeks post-germination, to correlate with the drought experiment. Temperature points represent an average of all plants for the accession, per treatment. Plants were re-watered to full saturation on day 9 (vertical line), after all measurements were taken for day 9. Note break in time scale after day 9. Day 12 measurements were taken after 3 days of watering and recovery. ("pp2C" corresponds to PP2C quadruple knock-out mutant plants in the ABI1, ABI1, HAB1 and PP2CA genes), as described in detail in Example 4, below.
Figure 34B:
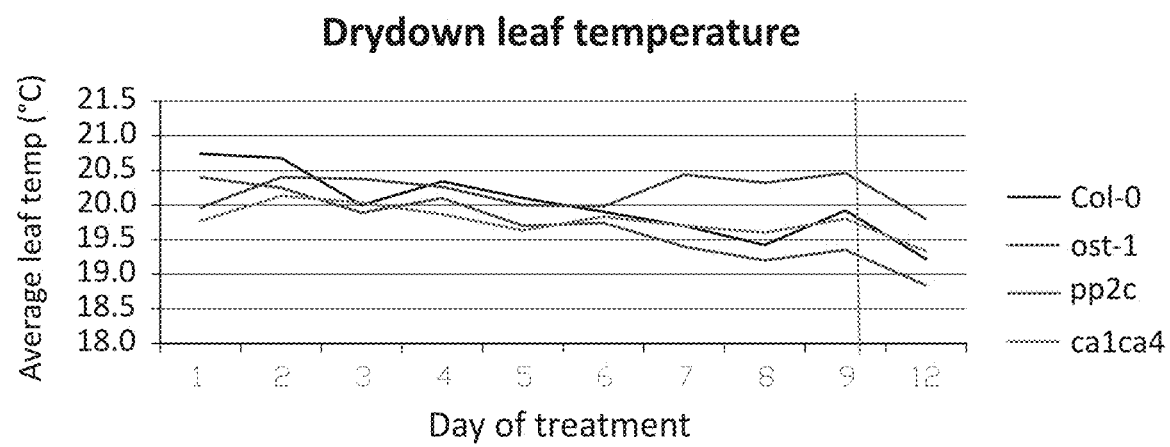

Confirmation of Phenotypes for Activation Tagging Mutants and New Protease Mutants:

Strong candidates isolated from our previously reported activation tagging screen can be identified. Using infra-red thermography, we re-screened 16 of the positive hits for suppressor and enhancer mutant lines of the ca1ca4 cool leaf thermal phenotype of ca1ca4 mutant plants. 10 plants from 16 independent lines were imaged every 2 days (FIG. 34). These IR thermography experiments can be pursued further and strong candidates (FIG. 34; e.g. Lines 3, 4, and 7) with reproducible phenotypes can be characterized for T-DNA insertion genomic flanking regions using TAIL-PCR next to identify the putative genetic loci responsible for the observed mutant phenotypes.

Next Gen RNAseq for Ht1-2 and Columbia WT Guard Cells from Mature Whole Leaf Epidermal Fragments:

The ht1-2 mutant has a warmer leaf phenotype and understanding the mechanisms involved with this gene's function could aid efforts for engineering drought resilience in crops. In order to determine the transcriptional targets of HT1, three separate batches of ht1-2 and Columbia WT plants were grown at ambient CO2 and epidermal fragment samples enriched for guard cells were collected for RNA-Seq analyses. Mature, healthy leaves were harvested and blended in a Warring blender and epidermal fragments enriched for guard cells were washed and purified. RNA from these samples will be extracted and subject to RNA-Seq analyses to identify HT1 targets (regulated transcriptionally).

Water Limitation and Drought Phenotyping Studies:

Development of a New Drought Stress Protocol for Guard Cell-Targeted Carbonic Anhydrase Over-Expression Lines.

Figure 35:
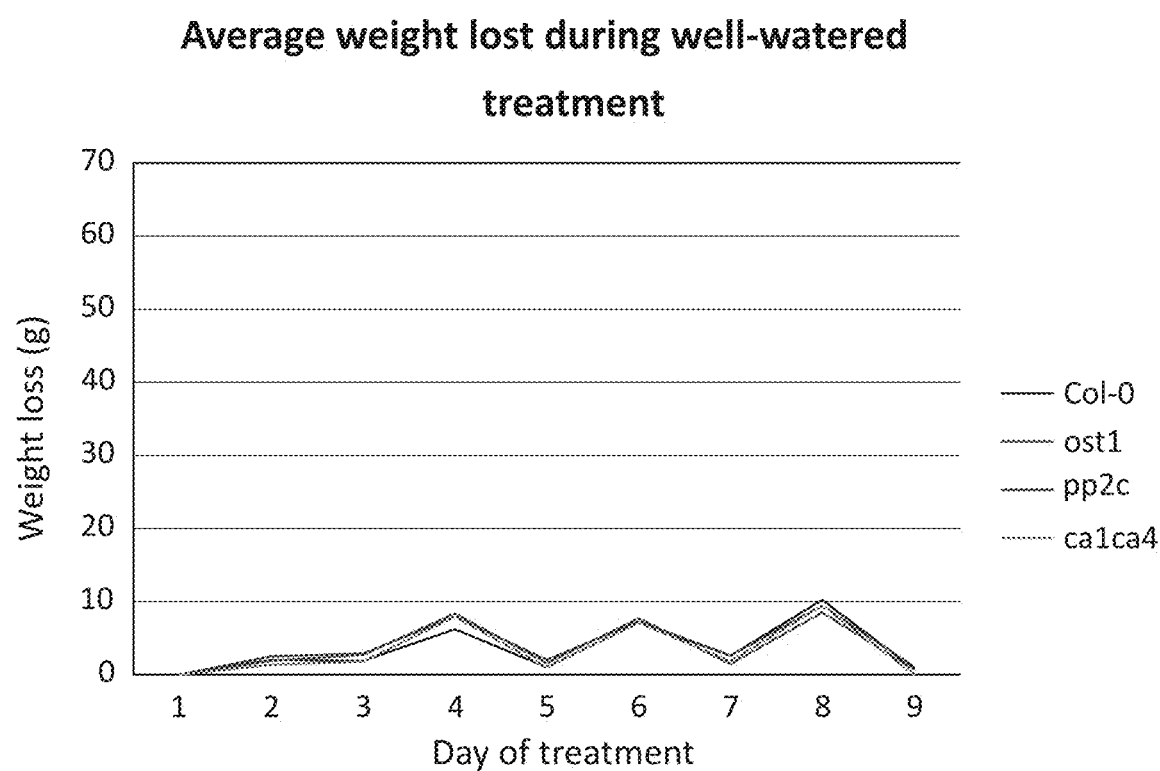
FIG. 35: Graphically illustrates water loss of well-watered plants. On day 1, plants were 6 weeks post-germination. Pot weight data were subtracted from initial pot weight to indicate weight lost due to transpiration and evaporation. Peaks and troughs reflect watering schedule every $2^{nd}$ day and the fact that plants were well-watered (i.e. not exposed to drought stress) in this experiment. ("pp2C" corresponds to PP2C quadruple knock-out mutant plants in the ABB, ABI1, HAB1 and PP2CA genes), as described in detail in Example 4, below.
Figure 36:
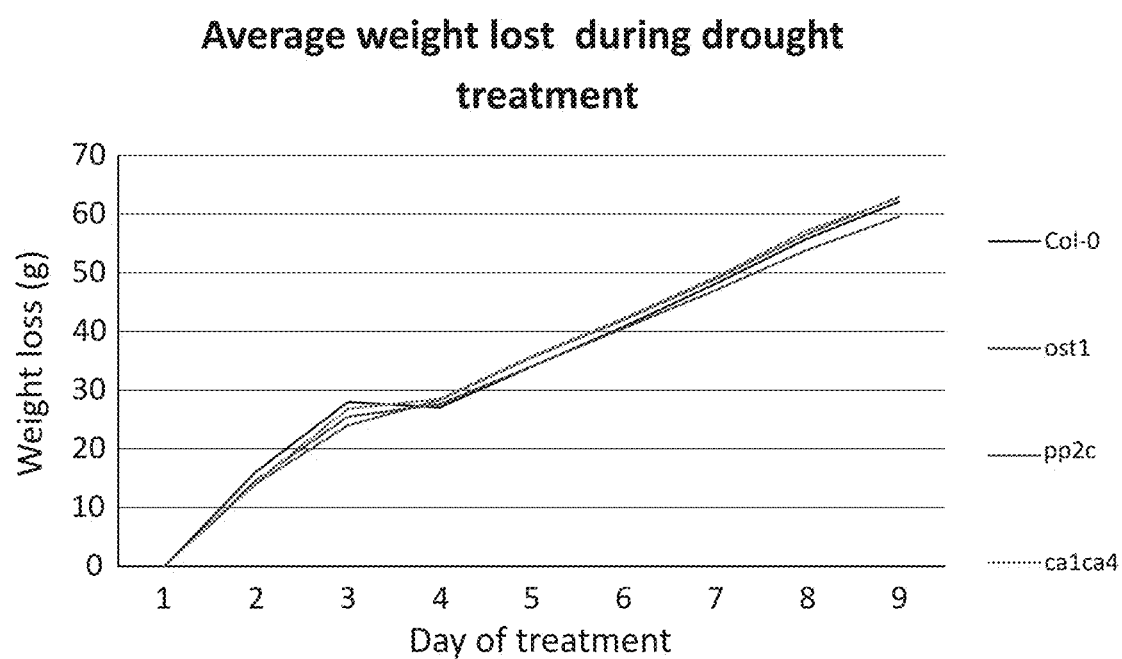
FIG. 36: Graphically illustrates water loss of drought stressed plants. On day 1, plants were 6 weeks post-germination. Pot weight data were subtracted from initial pot weight to indicate weight lost due to evaporation and transpiration. These data demonstrate that with this method we can impose a rapid and uniform drought regimen. ("pp2C" corresponds to PP2C quadruple knock-out mutant plants in the ABB, ABI1, HAB1 and PP2CA genes), as described in detail in Example 4, below.

A new drought simulation protocol was tested that reduces the length of time needed to simulate drought conditions. In developing an improved drought stress protocols, we have grown plants in a fitted clay soil that allows for rapid water loss of approximately 10% soil water content loss per day. Thermal images and weights of the pots were recorded to observe temperature differences (FIGS. 34a and 34b) and water loss (FIGS. 35 and 36). (n=3 to 10 plants, depending on line, due to some plants dying prior to measurement).

Plants were grown in 2.5 inch square pots lined with landscape fabric at the bottom to encourage wicking and to prevent soil escape. After labeling each pot with accession and replicate number, the dry weight of each pot with cloth was recorded. Pots were filled with pre-dried "PROFILE POROUS CERAMIC™ (PPC) "Greens Grade" soil to about 1 cm below the top of the pot (Profile Products LLC, Buffalo Grove, Ill.). The dry weight of soil+pot was recorded for each pot. To remove dust and any possible salts from the clay, the bottom of each tray was filled with water to 2 cm up the sides of the pots, the trays covered with domes and allowed to soak overnight. The following day, remaining water was siphoned off and refilled with fresh water. This was repeated for a total of three times. Flats were then filled with ½ strength Hoagland's nutrient solution, covered with domes and allowed to soak overnight. The next day, remaining standing solution was siphoned off, and the pots were allowed to drain for one hour. The bottoms of the pots were blotted with paper towels to remove any remaining droplets of water, and the saturated weight was recorded.

Six CA1 and CA4 over-expression lines were tested. Col-0, ost-1, and PP2C quadruple mutants were included as controls. *Arabidopsis* seeds were surface sterilized with ethanol then suspended in 0.1% agar in 1.5 ml Eppendorf tubes. Tubes were wrapped with foil and kept at 4° C. for 3 days. After three days, seeds were pipetted into the center of the appropriately labeled pot. The soil was misted heavily, trays covered with domes and moved to the growth rooms which are maintained at an average temperature of 22° C. and humidity of 50%. Trays were monitored daily for germination, and germination dates were recorded for each pot. If germination did not occur in a pot, extra seedlings from other pots of the same accession were transplanted, when available. Plants were grown with 16 hour day length. Trays were bottom watered to saturation every other day, allowed to stand in water for one hour, then remaining water was siphoned off to allow oxygenation of the soil. Plants were fertilized with half-strength Hoagland's once a week in place of watering, following the same procedure as used for watering.

Six weeks post-germination, pots were allowed to drain one hour post-watering and blotted with paper towels to obtain a starting weight. For the saturated treatment, all pots were bottom watered every two days as described above. Pot weight was measured daily as described above. For the drought treatment, the gravimetric water content (GWC—the mass of water per unit mass of dry soil) was calculated so each pot could be held to the same level of drydown each day. We targeted 100, 90, 80, 70, 60, 50, and 40% of water remaining in drought treatment pots. These pots were weighed daily and the remaining water content calculated. Water was added by pipette, if needed, to maintain all pots at the target soil water content for that day. If all pots remained above the target water content for the day, the target water content would be extended to the following day. When drought treatment pots reached 40% water content, they were re-watered to saturation and allowed to recover for three days before a final saturated recovery measurement was taken.

Seeds can be germinated on MS plates then transferred as seedlings onto the fitted clay soil as many plants were lost during germination. Also, plant dry mass was not calculated for studies used to develop the drought protocol, but will be determined in subsequent studies with the new homozygous single insertion CA-over-expressing lines. Measurements and drought treatments can begin at a younger plant age, as plants began to bolt partway through the treatment. Also, in subsequent experiments, the soil can be allowed to dry to a point where ost1 mutant plants begin to wilt, to be certain that the plants are exposed to a level of drought that elicits a strong physiological response. The optimal drought level may also be maintained for several days longer to further stress the plants so the response may be characterized more completely.

REFERENCES, EXAMPLE 4

Hu H, Boisson-Dernier A, Israelsson-Nordstrom M, Bohmer M, Xue S, Ries A, Godoski J, Kuhn J M, Schroeder J I (2010) Carbonic anhydrases are upstream regulators of CO2-controlled stomatal movements in guard cells. Nature Cell Biology 12: 87-93

Xue S, Hu H, Ries A, Merilo E, Kollist H, Schroeder J I (2011) Central functions of bicarbonate in S-type anion channel activation and OST1 protein kinase in $CO_2$ signal transduction in guard cell. EMBO J 30: 1645-1658.

Example 5: Epistasis Analyses for Combinations of epf2 and Crsp Mutants

This example presents describes and presents data confirming whether, or not, CRSP and EPF2 function in the same pathway.

Figure 37:
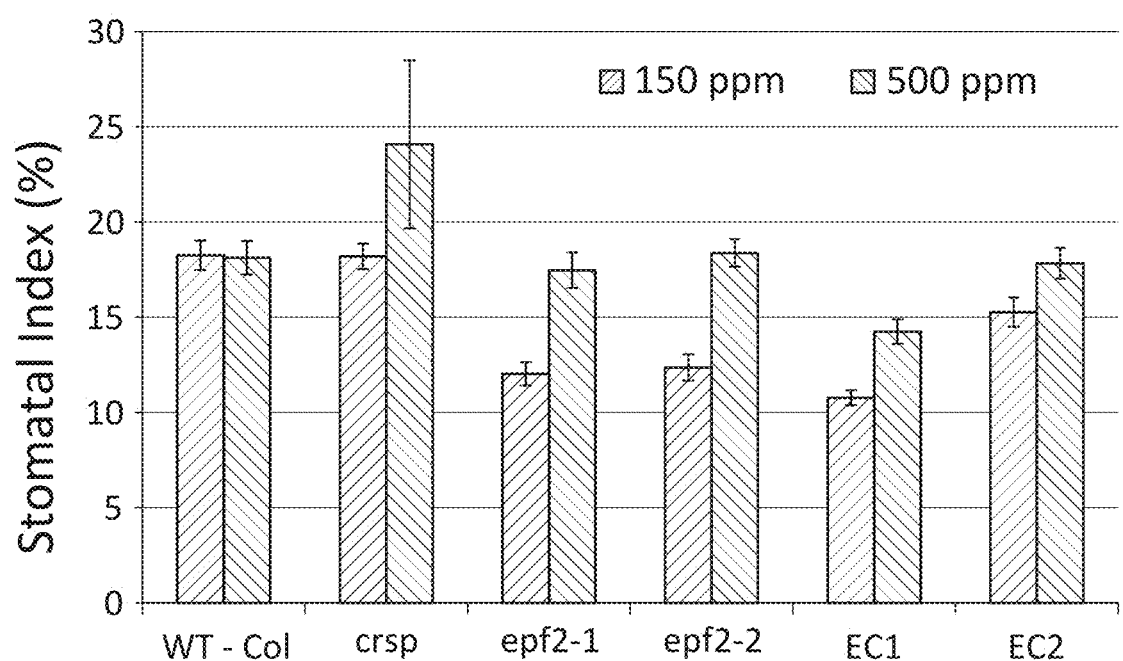
FIG. 37: Graphically illustrates abaxial stomatal indices (i.e. the percent of epidermal cells which are stomata) for mature cotyledons (10 days after germination) of Columbia (WT) and the crsp and epf2-1 and epf2-2 single mutants, and the crsp,epf2-1 and crsp, epf2-2 double mutants (EC1 and EC2) grown at low (blue) and high (red) $CO_2$, as described in detail in Example 5, below.

The CO2-dependent stomatal development experiment for the double mutants of crsp with epf2-1 and epf2-2 was repeated independently. This study confirms, as illustrated in FIG. 37, results obtained previously: the double mutant combinations do not show additive phenotypes compared to single mutants, indicating that both EPF2 and CRSP function in the same pathway for $CO_2$-dependent stomatal development.

Figure 38A:
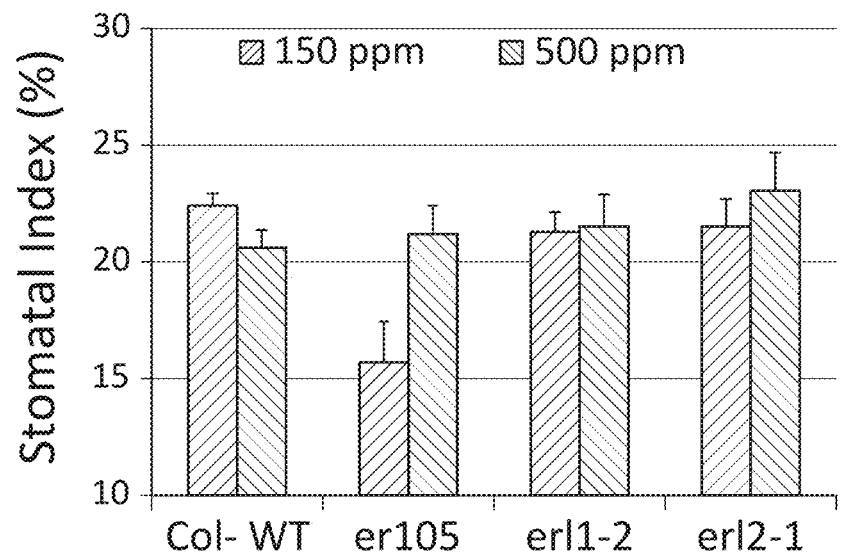
FIG. 38: Graphically illustrates data when small cells are included in the SI calculations: Abaxial stomatal indices (i.e. the percent of epidermal cells which are stomata) for mature cotyledons (10 days after germination) of Columbia (WT) and the erl05, erl1-2, and erl2-1 single (FIG. 38A) and double (FIG. 38B) mutants grown at low (150 ppm; blue) and high (500 ppm; red) $CO_2$, as described in detail in Example 5, below.
Figure 38B:
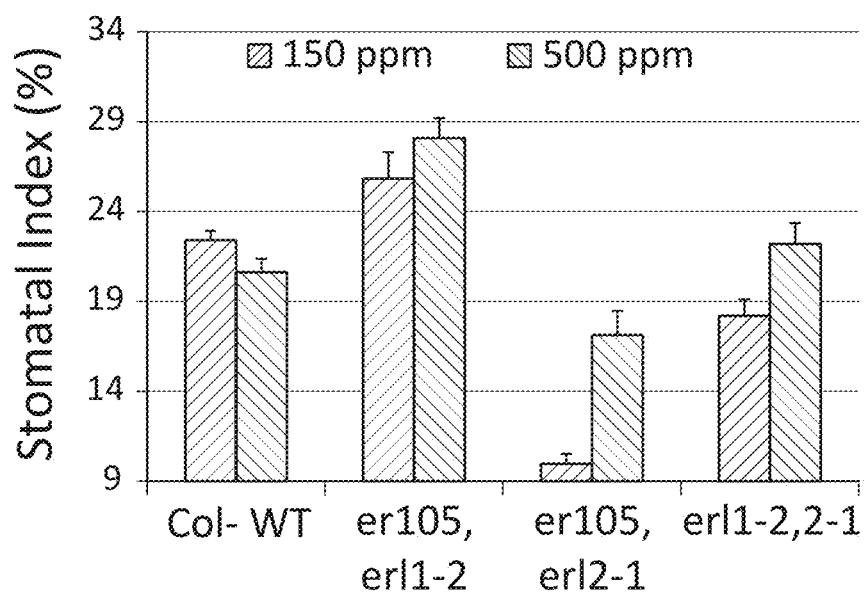
Figure 39A:
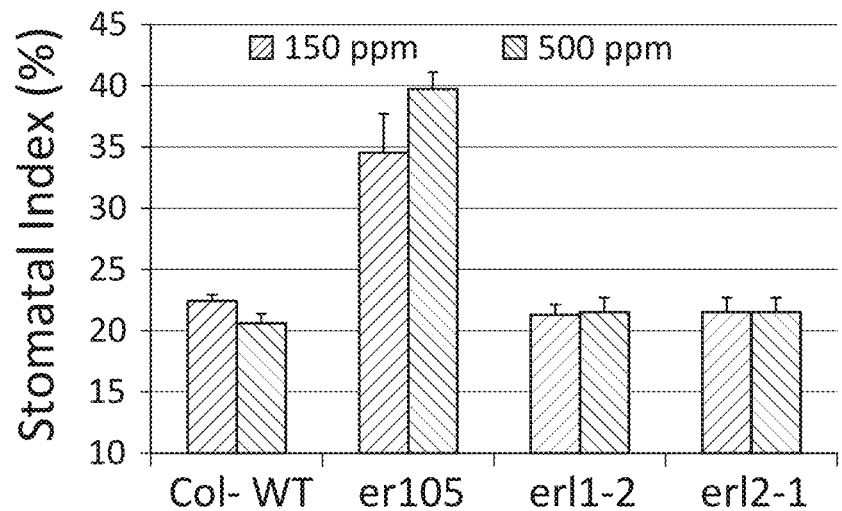
FIG. 39: Graphically illustrates data when small cells are NOT included in the SI calculations: Abaxial stomatal indices (i.e. the percent of epidermal cells which are stomata) for mature cotyledons (10 days after germination) of Columbia (WT) and the erl05, erl1-2, and erl2-1 single and double mutants grown at low (150 ppm; blue) and high (500 ppm; red) $CO_2$, as described in detail in Example 5, below.
Figure 39B:
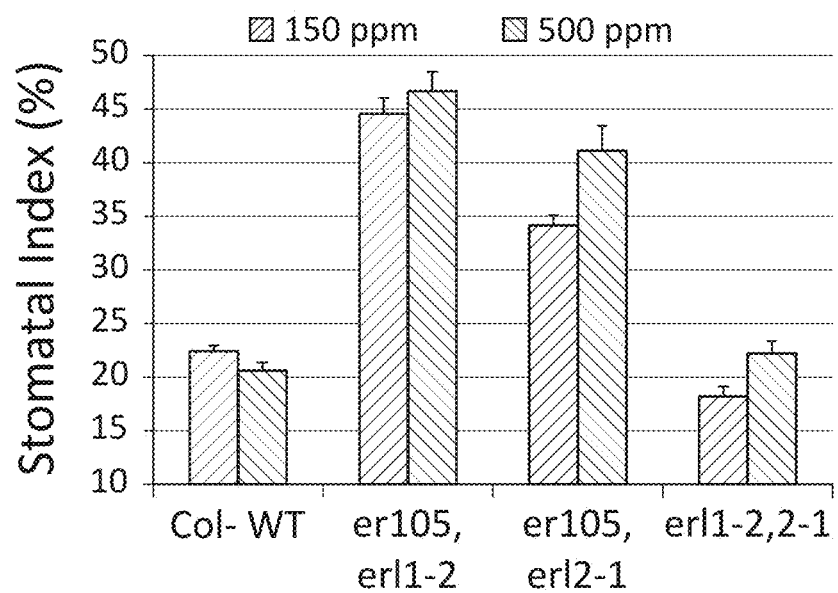

$CO_2$ Control of Stomatal Development for the *Erecta* Single and Double Mutants:

Er-Epf2 and Erl1-Epf1 have been shown to form ligand receptor pairs. Initial experiments on receptor protein mutants implicate the ERECTA receptor to be involved in CO2 control of stomatal development. New double blinded experiments were conducted for the third time for the *erecta* single and double mutants. SI calculations with and without small cells are shown in FIGS. 38 and 39, respectively. These results confirm previous results and further strengthen our model that $CO_2$ control of stomatal development is exerted via EPF2 (and its receptor *ERECTA*) and not through EPF1.

Figure 40:
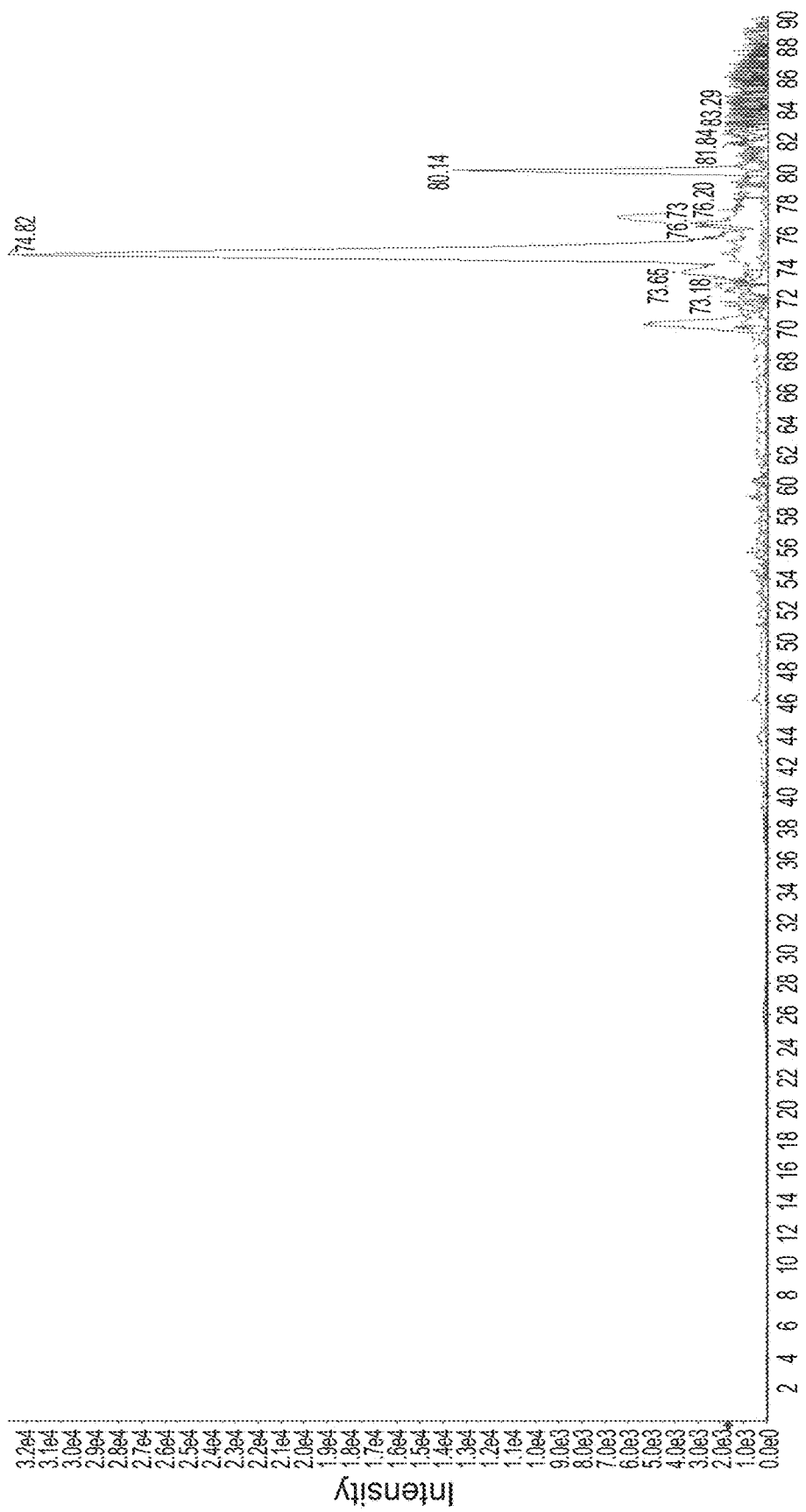
FIG. 40: MS spectra for in vitro cleavage reaction between synthetic EPF2 and ($CO_2$-regulated secreted subtilisin-like serine protease (CRSP). The predicted cleavage site is shown in red and experimentally determined site is shown in green, as described in detail in Example 5, below.

EPF2 Cleavage Site Determination by CRSP: In Vitro Cleavage Reactions:

In order to determine the precise cleavage site where CRSP processes EPF2, in vitro digests of synthetic EPF2 and CRSP were run for 30 minutes. Three species were identified in the MALDI-TOF-MS analysis (FIG. 40) and the predominant peak corresponds to the largest cleavage fragment: SKNGGVEMEMYPTGSSLPD (SEQ ID NO:129) (14 hits). Abundance of this larger fragment is predicted to be much higher than the other species.

Two minor species were also detected: SKNGGVEME-MYPTGSSL (SEQ ID NO:130) (3 hits) and SKNGGVE-MEMYPTGS (SEQ ID NO:131) (5 hits). The 30 aa, full length, uncleaved peptide was also seen (14 hits).

Mature leaf apoplastomics: Confirmation of CRSP identification with new hits in proteomic experiments: 20 mature rosette leaves for WT and ca124 were excised and apoplast proteins were isolated. Most proteins, over 70%, that were isolated were annotated as secreted on the TAIR website. The CRSP protease was identified in these samples with 21 independent peptide hits.

A number of embodiments of the invention have been described. Nevertheless, it can be understood that various modifications may be made without departing from the spirit and scope of the invention. Accordingly, other embodiments are within the scope of the following claims.

SEQUENCE LISTING (132 sequences)

SEQ ID NO: 1 - DNA, 2310 bp, Arabidopsis thaliana
atgaaaggcattacattcttcacaccctttttatcatttctatatctcttatgcatcttgtttatgacagaaactgaagctgggtcgagaaatggtgatggggtctacattgtctacatgggatcagcttcctctgctgcaaacgctaatagagctcaaatactcataaacaccatgtttaaaaggagagcaaacgatcttctccacacatataagcatggcttctcaggttttgcagctcgtttgacagcagaagaggccaaggtcatagccaagaaaccgggagtggtttcagtttttcctgacccacacttccagcttcatacaactcattcatgggactttctcaagtaccaaacatcagtaaaggtcgattccggtccaccttcatcagcctcagatggatcatatgatagcattgtcggaattcttgacacagggatatggccagagtcagagagtttcaatgacaaagacatgggtccaattccgtctcggtggaaaggtacatgcatggaagcaaaggacttcaagtcttccaactgtaacagaaagatcattggagcaagatactacaaaaatcctgatgatgattcagaatactataccacaagggatgtcatcggtcacggttctcatgtgtcctccaccatagctggatctgccgtggagaatgcttcctactatggtgtagcttccgggactgcaaagggaggttcacaaaacgctagaatcgctatgtacaaagtatgcaatccagggggatgcactggctcctctatcttagctgctttcgatgatgcaatcgcagatggagttgatgttctatctctgtctcttggagctccagcatacgctcgcatcgacttgaacactgatcctattgccattggagcgtttcacgcggtggagcaaggaatcttggtgatctgctctgcgggtaatgatggacctgatggcggtacagttactaatactgcaccttggataatgaccgttgctgccaacactattgatagagactttgagtctgatgttgtactaggcggcaataaagtcatcaagggtgaaggtatacacttttcaaacgttagtaaatctcctgtgtatcctctgattcatggcaagtctgctaagagcgctgatgcatcagaaggatcagccagggcctgtgactctgattctctagatcaagagaaggtaaaagggaagattgtgttatgcgagaacgttggtggatcatattatgcatcatccgctagggacgaggtgaagagcaaaggaggtactggttgcgtctttgtagatgacagaactagagcagttgctagtgcttatggtagctttcctactaccgtaattgactcaaaggaagcagctgagatcttctcctacctcaactcaaccaaagatcctgttgcaacaattcttcccactgcaacagttgaaaagttcacacctgcccctgctgttgcatatttttcttccagaggaccttcaagcctcacaagaagcattctcaaacctgacattaccgcaccaggagtctcgatactcgctgcatggactggaaacgactcaagcatttcactggaaggcaagccggcttctcagtataacgtcatatcaggaacttccatggcagctcctcatgtttcagctgttgcatctctgatcaaatcacagcatcccacatggggtccatccgcgatcagatcagcaattatgacaacagcgactcaaacaaacaacgacaaaggtcttataacaacagaaactggtgcaacagccacaccttatgactctggagcaggagaactaagctcaacagcatcaatgcaaccaggactagtttacgagactactgaaactgactacctgaactttctctgttactatggatataacgtaaccacaataaaggctatgtcaaaagcttttccagagaattttacttgccctgcagattccaacttagacttgatctccaccatcaattacccgtcaattggaatctctggattcaaaggaaatggtagcaagacagttacaagaacagtgaccaatgttggtgaggacggtgaggcggtttacacagtcagcgtggaaacaccaccagggtttaacattcaagtgacgccagaaaaactccaatttacaaaagatggtgagaagttgacataccaggtgatagtgtctgctactgcttcacttaagcaagatgtatttggggctcttacttggtctaatgccaagtacaaggtcagaagcccaattgtaattagtagcgagagtagccgcacaaactga

SEQ ID NO: 2 - protein, 769 aa, Arabidopsis thaliana
MKGITFFTPFLSFLYLLCILFMTETEAGSRNGDGVYIVYMGSASSAANANRAQILINTMFKRRANDLLHTYKHGFSGFAARLTAEEAKVIAKKPGVVSVFPDPHFQLHTTHSWDFLKYQTSVKVDSGPPSSASDGSYDSIVGILDTGIWPESESFNDKDMGPIPSRWKGTCMEAKDFKSSNCNRKIIGARYYKNPDDDSEYYTTRDVIGHGSHVSSTIAGSAVENASYYGVASGTAKGGSQNARIAMYKVCNPGGCTGSSILAAFDDAIADGVDVLSLSLGAPAYARIDLNTDPIAIGAFHAVEQGILVICSAGNDGPDGGTVTNTAPWIMTVAANTIDRDFESDVVLGGNKVIKGEGIHFSNVSKSPVYPLIHGKSAKSADASEGSARACDSDSLDQEKVKGKIVLCENVGGSYYASSARDEVKSKGGTGCVFVDDRTRAVASAYGSFPTTVIDSKEAAEIFSYLNSTKDPVATILPTATVEKFTPAPAVAYFSSRGPSSLTRSILKPDITAPGVSILAAWTGNDSSISLEGKPASQYNVISGTSMAAPHVSAVASLIKSQHPTWGPSAIRSAIMTTATQTNNDKGLITTETGATATPYDSGAGELSSTASMQPGLVYETTETDYLNFLCYYGYNVTTIKAMSKAFPENFTCPADSNLDLISTINYPSIGISGFKGNGSKTVTRTVTNVGEDGEAVYTVSVETPPGFNIQVTPEKLQFTKDGEKLTYQVIVSATASLKQDVFGALTWSNAKYKVRSPIVISSESSRTN

SEQ ID NO: 3 - protein, 2193 aa, Arabidopsis thaliana
ATGGGATCAGCTTCCTCTGCTGCAAACGCTAATAGAGCTCAAATACTCATAAACACCATGTTTAAAAGGAGAGCAAACGATCTTCTCCACACATATAAGCATGGCTTCTCAGGTTTTGCAGCTCGTTTGACAGCAGAAGAGGCCAAGGTCATAGCCAAGAAACCGGGAGTGGTTTCAGTTTTTCCTGACCCACACTTCCAGCTTCATACAACTCATTCATGGGACTTTCTCAAGTACCAAACATCAGTAAAGGTCGATTCCGGTCCACCTTCATCAGCCTCAGATGGATCATATGATAGCATTGTCGGAATTCTTGACACAGGGATATGGCCAGAGTCAGAGAGTTTCAATGACAAAGACATGGGTCCAATTCCGTCTCGGTGGAAAGGTACATGCATGGAAGCAAAGGACTTCAAGTCTTCCAACTGTAACAGAAAGATCATTGGAGCAAGATACTACAAAAATCCTGATGATGATTCAGAATACTATACCACAAGGGATGTCATCGGTCACGGTTCTCATGTGTCCTCCACCATAGCTGGATCTGCCGTGGAGAATGCTTCCTACTATGGTGTAGCTTCCGGGACTGCAAAGGGAGGTTCACAAAACGCTAGAATCGCTATGTACAAAGTATGCAATCCAGGGGGATGCACTGGCTCCTCTATCTTAGCTGCTTTCGATGATGCAATCGCAGATGGAGTTGATGTTCTATCTCTGTCTCTTGGAGCTCCAGCATACGCTCGCATCGACTTGAACACTGATCCTATTGCCATTGGAGCGTTTCACGCGGTGGAGCAAGGAATCTTGGTGATCTGCTCTGCGGGTAATGATGGACCTGATGGCGGTACAGTTACTAATACTGCACCTTGGATAATGACCGTTGCTGCCAACACTATTGATAGAGACTTTGAGTCTGATGTTGTACTAGGCGGCAATAAAGTCATCAAGGGTGAAGGTATACACTTTTCAAACGTTAGTAAATCTCCTGTGTATCCTCTGATTCATGGCAAGTCTGCTAAGAGCGCTGATGCATCAGAAGGATCAGCCAGGGCCTGTGACTCTGATTCTCTAGATCAAGAGAAGGTAAAAGGGAAGATTGTGTTATGCGAGAACGTTGGTGGATCATATTATGCATCATCCGCTAGGGACGAGGTGAAGAGCAAAGGAGGTACTGGTTGCGTCTTTGTAGATGACAGAACTAGAGCAGTTGCTAGTGCTTATGGTAGCTTTCCTACTACCGTAATTGACTCAAAGGAAGCAGCTGAGATCTTCTCCTACCTCAACTCAACCAAAGATCCTGTTGCAACAATTCTTCCCACTGCAACAGTTGAAAAGTTCACACCTGCCCCTGCTGTTGCATATTTTTCTTCCAGAGGACCTTCAAGCCTCACAAGAAGCATTCTCAAACCTGACATTACCGCACCAGGAGTCTCGATACTCGCTGCATGGACTGGAAACGACTCAAGCATTTCACTGGAAGGCAAGCCGGCTTCTCAGTATAACGTCATATCAGGAACTTCCATGGCAGCTCCTCATGTTTCAGCTGTTGCATCTCTGATCAAATCACAGCATCCCACATGGGGTCCATCCGCGATCAGATCAGCAATTATGACAACAGCGACTCAAACAAACAACGACAAAGGTCTTATAACAACAGAAACTGGTGCAACAGCCACACCTTATGACTCTGGAGCAGGAGAACTAAGCTCAACAGCATCAATGCAACCAGGACTAGTTTACGAGACTACTGAAACTGACTACCTGAACTTTCTCTGTTACTATGGATATAACGTAACCACAATAAAGGCTATGTCAAAAGCTTTTCCAGAGAATTTTACTTGCCCTGCAGATTCCAACTTAGACTTGATCTCCACCATCAATTACCCGTCAATTGGAATCTCTGGATTCAAAGGAAATGGTAGCAAGACAGTTACAAGAACAGTGACCAATGTTGGTGAGGACGGTGAGGCGGTTTACACAGTCAGCGTGGAAACACCACCAGGGTTTAACATTCAAGTGACGCCAGAAAAACTCCAATTTACAAAAGATGGTGAGAAGTTGACATACCAGGTGATAGTGTCTGCTACTGCTTCACTTAAGCAAGATGTATTTGGGGCTCTTACTTGGTCTAATGCCAAGTACAAGGTCAGAAGCCCAATTGTAATTAGTAGCGAGAGTAGCCGCACAAACTGA

SEQ ID NO: 4 - protein, 730 aa, Arabidopsis thaliana
MGSASSAANANRAQILINTMFKRRANDLLHTYKHGFSGFAARLTAEEAKVIAKKPGVVSVFPDPHFQLHTTHSWDFLKYQTSVKVDSGPPSSASDGSYDSIVGILDTGIWPESESFNDKDMGPIPSRWKGTCMEAKDFKSSNCNRKIIGARYYKNPDDDSEYYTTRDVIGHGSHVSSTIAGSAVENASYYGVASGTAKGGSQNARIAMYKVCNPGGCTGSSILAAFDDAIADGVDVLSLSLGAPAYARIDLNTDPIAIGAFHAVEQGILVICSAGNDGPDGGTVTNTAPWIMTVAANTIDRDFESDVVLGGNKVIKGEGIHFSNVSKSPVYPLIHGKSAKSADASEGSARACDSDSLDQEKVKGKIVLCENVGGSYYASSARDEVKSKGGTGCVFVDDRTRAVASAYGSFPTTVIDSKEAAEIFSYLNSTKDPVATILPTATVEKFTPAPAVAYFSSRGPSSLTRSILKPDITAPGVSILAAWTGNDSSISLEGKPASQYNVISGTSMAAPHVSAVASLIKSQHPTWGPSAIRSAIMTTATQTNNDKGLITTETGATATPYDSGAGELSSTASMQPGLVYETTETDYLNFLCYYGYNVTTIKAMSKAFPENFTCPADSNLDLISTINYPSIGISGFKGNGSKTVTRTVTNVGEDGEAVYTVSVETPPGFNIQVTPEKLQFTKDGEKLTYQVIVSATASLKQDVFGALTWSNAKYKVRSPIVISSESSRTN

SEQ ID NO: 5 - protein, 722 aa, Triticum aestivum
MCFLLGVGFCFDGFLLSCDYVDAEHPSVISVFPNRGHKLHTTRSWEFLGMEKDGRVRPNSIWAKARYGEGVIIGNLDTGVWPEAGSFSDDGMGPVPARWRGVCHDQSSSDDAQVRCNRKLIGAQYFNKGYAATVGRAGAGASPASTRDSDGHGTHTLSTAAGRFVPGANLFGYGNGTAKGGAPGARVAAYKVCWRPVNGSECFDADIIAAFDAAIHDGVDVLSVSLGGAPTDYFRDGVAIGSFHAVRNGVTVVTSAGNSGPGAGTVSNTAPWLVTVGASTMDREFPAYLVLGNKKRIKGQSLSPVPLPANKHYRLISSVEAKAEDATVAQAQLCMEGSLDKKKARGKIVVCMRGKNARVEKGEAVHRAGGVGLVLANDEATGNEMIADAHVLPATHITYSDGVALLAYMNSTRLASGYITLPNTALETKPAPFMAAFSSQGPNTVTPQILKPDITAPGVSILAAFTGLAGPTGLTFDSRRVLFNSESGTSMSCPHVAGIAGLLKALHPDWSPAAIKSAIMTTTRVQDNTRRPMSNSSFLRATPFAYGAGHVQPNRAADPGLVYDTNATDYLHFLCALGYNSTVIGTFMDGPNACPARPRKPEDLNYPSVTVPHLSASGEPRTVTRRVRNVGAEPAAYDVRVREPRGVSVSVRPSRLEFAAAGEEKEFAVTFRARAGRFLPGEYVFGQMVWSDGAGRRRHRVRSPVVVRVGAHRTSKTSVPVA

SEQ ID NO: 6 - protein, 571 aa, Triticum aestivum
DETLESKSPLDTEGHGTHTASTAAGSPVDGAGFYQYARGRAVGMAPTARIAAYKICWKSGCFDSDILAAFDEAVGDGVNVISLSVGSTYAADFYEDSIAIGAFGAVKKGIVVSASAGNSGPGEYTASNIAPWILTVGASTVDRGFPADAVLGDGSVYGGVSLYAGDPLNSTKLPLVYAADCGSRLCLIGELDKDKVAGKMVLCERGVNARVEKGAAVGKAGGIGMILANTEESGEELIADPHLIPSTMVGQKFGDKIRHYVKTDPSPTATIVFHGTVIGKSPSAPRVASFSSRGPNSRAAEILKPDVTAPGVNILAAWTGEASPTDLDIDPRRVPFNIISGTSMSCPHVSGLAALLRQAHPEWSPAAVKSALMTTAYNLDNSGEIIKDLATGTESTPFVRGAGHVDPNSALDPGLVYDADTADYIGFLCALGYTPSQIAVFTRDGSVADCLKKPARSGDLNYPAFAAVFSSYKDSVTYHRVVRNVGSDASAVYEAKVESPAGVDAKVTPAKLVFDEEHRSLAYEITLAVSGNPVIVDAKYSFGSVTWSDGKHNVTSPIAVTWPESAGAASM

SEQ ID NO: 7 - protein, 718 aa, Triticum aestivum
MPQPREGAAEMITEPKGTPLLLAKRLFWRTQKLPHFQLQRERTKHAPHAAIKNQQCPSTFLPNAPRTDPDPESIPIPSRQQSSRTHTEKEMRGSMHSSSYVVYLGCHSHGREGAALASNQERAKNSHYQFLGSVLGSEEKAQDAIFYSYTRYINGFAATLEEEDAMQISKHPSVISVFPNRGHKLHTTRSWEFLGMEKDGRVRPNSIWAKARYGDGVIIGNLDTGVWPEAGSFSDDGMGPVPARWRGVCHDQSSDDDAQVRCNRKLIGAQYFNKGYAATVGRAGAGASPASTRDSDGHGTHTLSTAAGRFVPGANLFGYGNGTAKGGAPGARVAAYKVCWRPFNGSECFDADIIAAFDAAIHDGVDVLSVSLGGAPTEYFRDGVAIGSFHAVRNGVTVVSSAGNSGPGAGTVSNTAPWLVTVGASTMDREFPAYLVLGNKKQIKGQSLSPVPLPANEHYRLISSVEAKAEDATVVQASASGYITLPNTALETKPAPFMAAFSSQGPNAVTPQILKPDITAPGVSILAAFTGLAGPTGLTFDSRRVLFNSESGTSMSCPHVAGIAGLLKALHPDWSPAAIKSAIMTTARVQDNTRKPMSNSSFLRATPFAYGAGHVQPNRAADPGLVYDTNAADYLHFLCALGYNSTVIDTFMDGPHACPTRPRKPEDLNYPSVTVPHLSASGEPHTVTRRVRNVGPAPGRRTTCRVHDPRRVSVFRAA

SEQ ID NO: 8 - protein, 791 aa, Brachypodium distachyon
MWVPLICFVVVALLATAGTGVVDAAAGRREVYVVYMGAVPPRTPPSFLQETHLRLVGSVLKGQVARNVVVQQYNHGFSGFAARLSKEEAAALRRKPGVVSVFPDPVYQLHTTRSWDFLQQQQQTDVVVKIGSSAKSRHSPNKPSAASSSSSATTAGDTIIGLLDSGIWPESPSFDDAGFGPVPARWKGTCMSGDDFNSSNCNKKLIGARYYDVGEVTRGGGVRRSGSARDQAGHGTHTSSTAAGNAVAGASYYGLASGTAKGGSAASRLAMYRVCSEEGCAGSAILAGFDDAIGDGVDVISVSLGASPYFSPDFSEDPIAIGAFHAVAKGVTVACSAGNAGPGSSTVVNAAPWIMTVAAATIDRDFESDVVLGGGNSSAVKGGAINFSNLDKSPKYPLITGESAKSSSVSDNKSASHCEPGTLDAGKIKGKIVLCHHSQSDTSKMVKVDELKSGGAVGSILVNDVERSVTTAYLDFPVTEVTSAAAANLHKYIASTSEPVATITPSITVTEFKPAPVVAYFSSRGPSSQTGNILKPDVAAPGVNILAAWIPTSSLPSGQKQPSQFNLISGTSMSCPHVAGAAATIKAWNPTWSPAAIRSAIMTTATQLNNDKAPMTTDAGSAATPFDYGAGQVNPSGALDPGLVYDLAEEDYLQFLCNYGYGASQIKLITSSLPSGFSCAANASKDLISDLNYPSIALTGLGNSSSGRTVSRAVTNVGAQEEATYTVAVAAPTGLDVKVVPSELQFTKSVKKLGFQVTFSSNSTAAKGTLSGSITWSDGKHTVRSPFVVSK

SEQ ID NO: 9 - protein, 779 aa, Brachypodium distachyon
MVNRAHFVILVLAYRLLVSLSAEAQQSKESYVVYMGGGGGRDAEAARAAHLQMLSSVAPMSGEEERASSTLTHSYHHAFEGFAAELTVEEAAALAAHERVVSVFRDRTLQLHTTRSWDFLDAQSGLRPDRLAARASADVIIGVIDSGVWPESPSFNDVGMGAVPARWRGVCMEGPDFNKTNCNKKLIGARYYGNEPGGSKATVKPPSTTATDSPRDTDGHGTHCTSTAAGAAVSGADYYGLGRAGPARGGAPGSRVAAYRACILGGCSGSALLKAIDDAVSDGVDVISMSVGVSSAFPDDFLSDPIAIGAFHAHRRGVLVVCSAGNDGPVPYTVVNAAPWIVTVAASTIDRAFQSSIVLGNGNVVKGIGINFSNQSLGGEHYPLVFGAQAVGRYTPVAEASNCYPGSLDPEKVRGKIVVCVGSTGTMMASRRVKKVVAEGSGASGLVLIDDAKMDEPYDAGSFAFSQVGSHVGAQILDYINSTKNPTAVILPTEDVNEFKPAPTVASFSARGPGGLTESILKPDLMAPGVSILAAWVPPPNPAVVPAGKKPSAFAFLSGTSMACPHVAGAGAFLKSAHPGWTPSMIRSALMTTATTRDNLGRPVASSTGGAATGHDMGAGEISPLRALSPGLVFDTTDKDYLDFLCYMGYDDKAVRTVSGDARFACPRGGASPDRIATGFNYPSISVPRLLAGKPVAVSRTAMNVGPPNATYAVVVEAPSGLSVTVAPERLVFSDRWTTAAYVVSFASQAGASKGYAHGAVTWSDGAHWVRTPFAVNVV

SEQ ID NO: 10 - protein, 770 aa, Brachypodium distachyon
MAALLVSVVFLLLLLLGIGLCSCGNVHIVYMGEKLPELHPELVRDSHHGMLAALLGSEQAAESAILYSYRHGFSGFAAVLTDTQAARLSDWPGVVRVVRNRVLDLHTTRSWDFMRVNPSPSGKSGILSESRFGEDSIIGVLDTGIWPESASFRDDGIGEVPRRWRGRCVAGDRFNASNCNRKIIGAKWYVKGYEAEYGKMNTTDINEYMSARDAVGHGTHTASTAAGALVADASFRGLASGVARGGAPRARLAVYKVCWATGDCTSADILAAFDDAIHDGVDVLSVSLGQAPPLPAYVDDVLSIGSLHAVMKGIVVVCSAGNSGPYSETVINSAPWVLTVAAGTIDRTFLAKITLGNNISYVGQTMYSGKHAATTMRIVYAEDVSSDNADDSDARSCTAGSLNATLVKGNVVLCFQTRGQRAAQVAVETIKKARGIGVIFAQFLTKDIASAFDIPLVQVDYQVGTSILAYTTGTRNPTVQFGCAKTILGELIGPEVAYFSSRGPSSLSPSILKPDITAPGVNILASWSPSVAISSAIGSVNFKIDSGTSMSCPHISGVAALLKSMHPNWSPAAVKSAMVTTANVRDEYGFEMVSEAAPYKQANPFDYGGGHVDPNRAAHPGLVYDMRPSDYVRFLCSMGYNNSAIGSMVQLHTPCQHTPKSQLNMNLPSITIPELRGKLMVPRTVTNVGLPTSRYRARVEAPPGVGVTVNPSLLIFNSTTNRLSFRVTFQAKLKVQGRYTFGSLTWEDGAHTVRIPLVVRTMISKFYVNA

SEQ ID NO: 11 - protein, 770 aa, Brachypodium distachyon
MSGILFFLFIFSFSTVSASTEQNQIYIVYLGEHMEAKSKEVIQEDHHALLLSVKGSEDKARASLLYSYKHSLNGFAALLSEEEATDLSARTEVVSTFPSEGRRSPHTTRSWEFLGFEEGLDSSEWLPSGANAGENVIVGMLDSGIWPESKSFGDEGLGPVPARWKGTCQGGDSFSPSSCNRKVIGARYYLKAYEARYGRLNATNGYRSPRDHDGHGTHTASTVAGRTVPGVAALGGFAAGTASGGAPRARLAIYKVCWPIPGPNPNIENTCFDADMLAAMDDAVGDGVDVMSVSIGSSGQPVRLADDGIAVGALHAARRGVVVVCSGGNSGPAPATVSNLAPWFLTVGASSIDRSFDSPIRLGNGKLVMGQTVTPYQLQGNRAYPMVYAAHAVVPGTPANVSDQCLPNSLAAEKVRGKIVVCLRGAGLRVAKGLEVKRAGGAAVVLGNPPMYGSEVPVDAHVLPGTAVSMANVNTILKYINSTAKPTAYLDSSTTVLDVKPSPVMAQFSSRGPNVLEPSILKPDVTAPGLNILAAWSEASSPTKLDGDNRVVKYNIMSGTSMSCPHVSAAAVLLKSAHPDWSPAAIRSAIMTTATTHNAEGSPIMNADGTVAGPMDYGSGHIRPKHALGPGLVYDASYQDYLLFACASGGAQLDHSFRCPKKPPRPYELNYPSLAVHGLNGSITVHRTVTNVGQHEAHYRVAVVEPKGVSVKVSPKRLSFSSKGEKKAFVIKIVARGRRSARVNRKYLAGSYTWSDGIHAVRSPIVVLVA

SEQ ID NO: 12 - protein, 800 aa, Brachypodium distachyon
MAGARSSGVRSMAANSLPLAALLICTLLFLDPAAAAGEARSSYVVYLGDHAHGSRLGGLDAADLAALEEKAAGSHHDLLATILGDKDKAREAIFYSYTKHINGFAANLNAAEAAQLARLPEVVSVFPNRAQQQLHTTRSWQFLGLSGPDGVSRGASWRKAKFGEGIIIGNIDTGVWPESESFRDHGLGSVPKNWKGTCEKGQDDKFHCNGKLIGARFFNKGYASGVGAPSDDPTFNSPRDNGGHGTHTLSTAAGAPSPGASVFGLGNGTATGGSPRARVAGYRVCFKPVNGSSCFEADILAAFDAAIHDGVHVLSVSLGGVGDRYDYFEDSIAIGSFHAVRHGITVVCSAGNSGPKPSKISNVAPWMFTVGASTMDRKFSSDVVFNGTKIKGESLSSNTLNQKTPYPMIDSTQAAAPGRSEDEAQLCLKGSLDPKKVHGKIVVCLRGDNARVAKGEVVHEAGGAGMVLANDASSGNEIISDPHVLPATHVGFHDGLLLFSYLKIDKAPVGMIEKPTTSVYTKPAPYMAAFSSQGPSPVNPEILKPDITAPGVGVIAAWTRATSPTELDNDKRRVAYNAISGTSMSCPHVAGIAGLIKALHPDWSPAAVRSALMTTAIEVDNKGQQILNSSFAAAGPFERGAGHVWPSRSFNPALVYDLSPDHYLEFLCALKYNASSMALFSGGGKAAYKCPESPPKLQDLNYPSITVLNLTSSGTTVKRTVKNVGWPGKFKAAVRDPPGVRVSVRPDVLLFAKKGEEKTFEVKFEVKNAKLAKDYSFGQLVWSNGKQFVKSPIVVQTKAA

SEQ ID NO: 13 - protein, 766 aa, Brachypodium distachyon
MWCHGKRSAIFAVAVAAAIVASAAAAVRDDLRTYIVHMSHSAMPDGFAEHGDWYASSLQSVSDSAAVLYTYDTLLHGYSARLTRAEAEALEAQPGVLLVNPETRYELHTTRTPEFLGLDGRTDALFPQSGTASDVVVGVLDTGVWPERASYDDAGFGPVPTGWKGKCEEGNDFNASACNKKLIGARFFLTGYEASKGPVDVSKESRSPRDNDGHGTHTSSTAAGSAVRGADLLGYASGTAKGMAPRARVATYKVCWVGGCFSSDILKGMEVAVADGVDVLSLSLGGGTSDYYRDSIAVGAFSAMEKGIFVSCSAGNAGPGAASLTNGAPWITTVGAGTLDRDFPAHVTLGNGKNYTGVSLYSGKQLPTTPVPFVYAGNASNSSMGALCMTGSLIPEKVAGKIVLCDRGTNARVQKGFVVKDAGGAGMVLANTAANGEELVADAHILPGSGVGEKAGNAMRTYASSDPNPTANIVFAGTKVGIQPSPVVAAFSSRGPNTVTPGVLKPDLIAPGVNILAAWSGSIGPSGIAGDNRRSSFNIISGTSMSCPHVSGLAALLRSAHQDWTPAAIRSALMTTAYTVYPNGNYNNGILDVATGRPATPLDIGAGHVDPSKAVDPGLVYDITAADYVDFLCAINYGPAQVAALAKHSTADRCSANRTYAVTALNYPSFSVTLPAAGGAEKHTRTVTNVGQPGTYKVTASAAAGGTPVSVSVEPSTLSFTKAGEKKSYTVSFAAGGKPSGTNGFGRLVWSSDHHVVASPIVVTWT

SEQ ID NO: 14 - protein, 771 aa, Brachypodium distachyon
MERLLPWLLQSYVVYLGGHSHGREGAVLASNQERAKNSHYRFLGSVLGSKEKAQDAIFYSYTKHINGFAATLEEEEAMEISKHPSVISVFPNRAHKLHTTRSWEFLGMEKGGRVKPNSIWAKARFGQGVIIGNLDTGVWPEAGSFDDDGMGPVPARWRGVCQNQVRCNRKLIGAQYFNKGYLATLAGEAAASPATARDTDGHGTHTLSTAAGRFVPGANLFGYGNGTAKGGAPGAHVAAYKVCWHPRAGSECADADILAAFDAAIHDGVDVLSVSLGTSPVDYFREGVAIGSFHAVMNGIAVVASAGNAGPRAGTVSNTAPWLFTVAASTMDREFPAYVVFANHSRRIKGQSLSPDRLPDNKHYPLISSEEAKATNATAQQARFCMEGSLDKTKVEGKIVVCMRGKAPRVEKGQSVHRAGGVGLVLANDEATGNEMIADAHVLPATHVTYSDGVELLAYIEATTFASGYITSPNTALETKPAPFMAAFSSQGPNIVTPQILKPDITAPGVSILAAFTGLVGPTSLPFDSRRVLFNSESGTSMSCPHVSGIAGLLKALHPDWSPAAIKSAIMTTARVQDNTRKPMSNSSFLRATPFGYGAGHVQPNRAADPGLVYDMGAADYLGFLCSLGYNSSVIETFMGDDHRTNTPHACTARRRPKPEDLNYPSIAVPHLSPSGKPLAVSRRVRNVGAGPASYGVRVDEPRGVSVSVRPARLEFAAAGEEKEFAVTFRARQGLYLPGEYVFGRMAWSDAAGRHHVRSPLVVRVGRGTAS

SEQ ID NO: 15 - protein, 792 aa, Brachypodium distachyon
MATRRRLLLFLLLVLTATTLLSQTAGATDADDGGRQAKKTYIFRVDHRAKPSVFPTHAHWYSSAAFASGADADGPLLEPLHVYDTVFHGFSASVSAPRADALRRHPAVLAAFEDRVRPLHTTRSPQFMGLRARLGLWSLADYGSDVIVGVLDTGVWPERRSLSDRNLPPVPARWRGGCDAGAAFPASSCNRKLVGARFFSQGHAAHYGDTAAVASNGSVEYMSPRDADGHGTHTATTAAGSVSYAASMEGYAPGVAKGVAPKARVAAYKVCWKGAGCLDSDILAGFDRAVADGVDVISVSIGGGNGATSPFYIDPIAIGAYGAVSRGVFVATSAGNEGPAAMSVTNLAPWLATVGAGTIDRSFPAEIVLGDGRRMAGVSLYSGKPLANNTMLSLYYPGRSGGLSASLCMENSIEPSLVAGKIVICDRGSSPRVAKGMVVKEAGGAAMVLANGEANGEGLVGDAHVLPACSVGESEGDTLKAYAANTTNPTATIVFRGTIVGVKPAPLVASFSARGPNGLVPEILKPDFIAPGVNILAAWTGATGPTGLESDPRRTEFNILSGTSMACPHASGAAALLRSAHPGWSPAAIRSALMTTAIVTDNRGGAVSDEAEHGRAATPFDYGAGHITLSKALDPGLVYDIGDEDYVVFMCSIGYEANAIEVITHKPVSCPAATNRKLSGSDLNYPSISVVFHGSNQSRTVIRTATNVGAEASATYKARVEMSGAAASSGVSVAVKPEKLVFSPAVKKQSFAVTVEAPAGPAAAPVYGHLVWSDGRGHDVRSPIVVTWLQPM

SEQ ID NO: 16 - protein, 777 aa, Brachypodium distachyon
MDLRNARWTAPSLCLVLVLVHASIYACAGAPKTYIVQMAASEMPSSFDYHHEWYASTVKSVSSAQLEAEAGDDDAYTRIVYNYETAFHGFAARLDEDEAERMAEAAGVLAVLPETVLQLHTTRSPDFLGIGPEISNSIWAAGLADHDVVVGVLDTGIWPESPSFSDKGLGPVPAKWKGLCQTGRGFTTKDCNRKIIGARIFYNGYEASSGPINETTELKSPRDQDGHGTHTAATAAGSSVQDAGLFGYARGVARGMAPRARVAAYKVCWAGGCFSSDILAAVDRAVSDGVDVLSISLGGGASPYYRDSLSIASFGAMQMGVFIACSAGNAGPDPISLTNLSPWITTVGASTMDRDFPAKVTLGNGANITGVSLYKGRQNLSPRQQYPVVYMGGNSSIPDPRSMCLEGTLEPRDVAGKIVICDRGISPRVQKGQVVKEAGGIGMILTNTAANGEELVADSHLLPAVAVGESEGTAAKKYSKTAPKPTATLSFAGTKLGIRPSPVVAAFSSRGPNYLTLEILKPDLIAPGVNILAAWSGDASPSSLSSDRRRVGFNILSGTSMSCPHVAGVAALLKASHPDWSPAQIKSALMTTAYVHDNTYSLLKDAATGKASTPFQHGAGHIHPLRALSPGLVYDIGQGDYLEFLCTQDLTPMQLKAFTKNSNMTCKHSLSSPGDLNYPAISAVFTDQPSVPLTVHRTVTNVGPPSSTYHVKVTKFKGADVVVEPNTLHFSSSNQKLAYKVTLRTKAAQKTPEFGALSWSDGVHIVRSPLVLLLGYT

SEQ ID NO: 17 - protein, 803 aa, Zea mays
MVNTGRFVVLVLAYRLLVPLLSGSAEPDHTTKESYVVYMGSPSGGGDPEAVQAAHLQMLSSIVPSDEQGRVALTHSYHHAFEGFAAALTDKEAAALSGHERVVSVFKDRALQLHTTRSWDFLEVQSGLQSGRLGRRASGDVIMGIVDTGVWPESPSFNDAGMRDVPARWRGVCMEGPDFKKSNCNKKLIGARFYGVQPESSASNASSSAVATPAATGSPRDTVGHGTHTASTAAGAVVSDADYYGLARGAAKGGAPSSRVAVYRACSLGGCSASAVLKAIDDAVGDGVDVISISIGMSSVFQSDFLTDPIALGALHAHQRGVLVVCSGGNDGPNPYTVVNSAPWILTVAASSIDRSFQSTIALGNGDVVKGVAINFSNHSLSGEQYPLVFGAQVAAHYAPVAEASNCYPGSLDAQKVAGKIVVCVSTDPMVSRRVKKLVAEGSGARGLVLIDDAEKDVPFVTGGFALSQVGTDAGAQILEYINSTKNPTAVILQTEDVGDFKPAPVVASFSARGPGLTESILKPDLMAPGVSILAATIPSTDSEDVPPGKKQSAYAIKSGTSMACPHVAGAAAFVKSAHPGWTPSMIRSALMTTATTTNNLGKPLASSTGAAATGHDMGAGEMSPLRALSPGLVFDTSTQDYLDLLCYYGYKEQQVRKISGAARFSCPAGAPSPDLIASAVNYPSISVPAEEGETRHRGAHRHERGALERDIRGHRRCAPRPGGAGLARPARVLEEMDDGEVRGELRRGRRRCREQGLRARRGHLVRRRALGADAVRGQCPLIWWSHRRFCFFHNHVLGCMSV

SEQ ID NO: 18 - protein, 768 aa, Zea mays
MAAPLGFFCMLLLLLLQLGHSSCNNVYIVYMGARNPELHPALVRDAHHGMLAGLLGSEQAAKDAILYSYRHGFSGFAAVLTDSQAARLAGSPGVVRVVRNRVLDLHTTRSWDFMRVDPSHSAGILPESRFGEDSIIGVLDTGIWPESASFRDDGMSEAPRRWKGQCVAGDRFNVSNCNRKIIGAKWYIKGYEAEYGKMNTTDIYEFMSARDAVGHGTHTASTAAGALVAGASFRGLAGGVARGGAPRARLAVYKVCWATGDCTSADILAAFDDAIHDGVDVLSVSLGQAPPLPAYVDDVLSIGSFHAVARGIVVVCSAGNSGPYSETVINSAPWLVTVAAGTIDRTFLAKIILGNNSTYVGQTLYSGKHPGNSMRIFYAEDVASNNADDTDARSCTAGSLNSTLVKGTVVLCFQTRAQRSAAVAVETVKKARGVGVIFAQFLTKDIASSFDIPCFQVDYQVGTAILAYTTSTRNPTVQFGSAKTILGELMGPEVAYFSSRGPSSLSPAVLKPDIAAPGVNILAAWTPAAAISSAIGSVKFKIDSGTSMSCPHISGVVALLKSMHPNWSPAAVKSALVTTASVHDTYGFEIVSEAAPYNQANPFDYGGGHVDPNSAAHPGLVYDMGTSDYVRFLCSMGYNVSAISSLAQQHETCQHTPKTQLNLNLPSISIPELRGRLTVSRTVTNVGSALTKYRARVEAPPGVDVTVSPSLLTFNSTVRKLTFKVTFQAKLKVQGRYYFGSLTWEDGVHAVRIPLVVRTMISKFYANS

SEQ ID NO: 19 - protein, 769 aa, Zea mays
MAALLGLFFLLLLQLGPSSCSNVYIAYMGERSPELRPALVRDAHHGMLAALLGSEQAARDAILYSYRHGFSGFAATLTDSQAARLADSPGVVRVVRNRVLDLHTTRSWDFMRVMSPSHSAGILSNSRLGEDSIIGVLDTGIWPESASFRDDGIGEVPRRWKGRCVAGDRFNASNCNRKIIGAKWYIRGYEAEYGKMNTTDIYEFMSARDAVGHGTHTASTAAGAPVADASFRGLASGVARGGAPRARLAVYKVCWATGDCTSADILAAFDDAIHDGVDVLSVSLGQAPPLPAYVDDVLSIGSFHAVARGIAVVCSAGNSGPYSETVINSAPWIVTVAAGTIDRTFLAKIALGNNSTYAGQTLYSGAHPGRSMSLVYAEDIASNDADDTDARSCTAGSLNSTLAKGKVVLCFQTRAQRSASVAVETVRKARGVGVIFAQFLTKDIASSFDVPCVQVDYQVGTVILAYTTSMRNPTVQFGSAKTVLGEVIGPEVAYFSSRGPSSLSPSVLKPDIAAPGVNILAAWTPAAAVSSAIGSVSFKIDSGTSMSCPHISGVVALLRSLHPNWSPAAVKSALVTTASVHDTYGFGIVSEAAPYSQANPFDYGGGHVDPNRAAYPGLVYDMGASDYVRFLCSMGYNVSAISSVAQQRETETCQHAPKTQLDLNLPSIAVPELRGRLTVSRTVTNVGSALSEYRARVEAPPGVDVSVRPSLLAFNSTVRRLAFKVTFRAKLVKVQGRYTFGSLTWEDGVHAVRIPLVVRTMVGRFYANS

SEQ ID NO: 20 - protein, 701 aa, Zea mays
MLYAYDTVLHGFSARLTPQEASDLASAEGVLAVNPEARYELHTTRTPEFLGIAGQGLSPQSGTAGDVVVGVLDTGVWPESKSYDDAGLAEVPAWWKGQCEAGPGFDASAACNRKLVGARFFSKGYEAAMGPMDTDRESRSPLDDDGHGTHTSSTAAGAAVPGASLFGFAAGTARGMAPRARVAAYKVCWLGGCFSSDILAGMDAAVADGCGVLSLSLGGGAADYSRDSVAIGAFAATEQNVLVSCSAGNAGPGSSTLSNVAPWITTVGAGTLDRDFPAYVVLGDGKNYTGVSLYAGKPLPSAPIPIVYAANASNSTAGNLCMPGTLVPEKVAGKIVVCDRGVSARVQKGLVVRDAGGAGMVLSNTAANGQELVADAHLLPAAGVGETEGTAIKSYVASAPNPTATVVVAGTEVGVRPSPVVAAFSSRGPNMVTPEILKPDMIAPGVNILASWTGKAGPTGLAADTRRVGFNIISGTSMSCPHVSGLAALLRSAHPEWSPAAVRSALMTTAYASYSGGSSLLDAATGGMATPFDYGAGHVDPARALDPGLVYDLGTRDYVDFLCALKYSSTMIAAVARSREYACAENKTYSVGALNYPSFSVAYSTANGDGGGDSATVTHTRTLTNVGGAGTYKASTSLAAAKGVAVDVEPAELEFTSVGEKKSYTVRFTSKSQPSGTAGFGRLVWSDGKHSVASPIAFTWT

SEQ ID NO: 21 - protein, 791 aa, Zea mays
MATRWRRSLLWVAVVQFLTLCVAEHLVVEAYKKSYIVYLGSHAYGRDASAEEHARATQSHHHLLASILGGDDDHHHETARQSIFYSYTKSSINGFAAHLEESVAQQIAEHPEVVAVLESKMLKLHTTRSWDFMDLERDGHVLPGSIWNHARFGQDVIIASLDSGVWPESHSFQDDGGQVPARWKGSCQDTVKYGVACNRKLIGARFFNKDMLFSNPAVVNANWTRDTEGHGTHTLSTAAGGFVPRASLFGYATGTAKGGAPRARVAAYKVCWSGECAAADVLAGFESAIHDGADVISVSFGQDAPLADDVKSLFHEPVMLGSLHAAIHGVSVICSAGNSGPYDDTVVNAAPWVTTVAATTVDRDFPNVLTLGNSVRLRGTSLESTTLHSSMLYPMIDAARAARTTSNPYDAASCGLGTLDPAAIRGKIVVCRRGGGGGGDVSRVSKGMAVLEAGGAGMILANDRMDGDDIVADPHVLPATMITYSEAVSLYGYMESTSNPVANISPAKTEVGVKNSPSVAGFSSRGPSGTLPYVLKPDIAAPGVDILAAFTEYVGPTELASDKRRSEYAILSGTSMACPHVSGVIALLKAARPEWSPAAMRSAIMTTARTQDNTGAPMRDHDGKEANAFAYGAGNVHPNRAVDPGLVYDAGPDDYFTFLCAMGISAADMKRLSAGKFACPANSAKEAPAMEDLNYPSIVVPSLRGTQTVTRRLKNVGRPAKYLASWRAPVGITMEVKPRVLEFSKVGEEKEFKVTVTSQQDKLGMGYVFGRLVWTDGTHYVRSPVVVNALA

SEQ ID NO: 22 - protein, 810 aa, Oryza sativa
MWLLPLICFVLALLLAAGAIGGGGGAAGGGNGGGGERRGVYVVYLGAVPPRTSPNILQQTHLRLIGAVLKRGQPVESVVVQQYKHAFSGFAARLSAAEAAALRRKPGVISVFADPVYHLHTTRSWDFLQQQTTAAVDVKTGGSARRRRRSPRARAAAASASTSSSPTADTIIGLLDSGVWPESPSFDDAGFGPVPARWKGVCMAGDDFNSSSCNRKLIGARYYDVGGEAKRQSARSSGSSPRDEAGHGTHTSSTAAGNAVNGASYYGLAAGTAKGGSASSRVAMYRVCSGEGCAGSAILAGFDDAVADGVDVISVSLGASPYFRPDFSDDPIAIGSFHAVAKGIMVVCSAGNAGPDAATVVNAAPWILTVAASTIDRYFQSDVVLGGNNTAVKGGAINFSNLNKSPKYPLITGESAKSSSVSDTESASHCEPGTLDASKIKGKIVLCHHSRNSDTPKTEKVGELKSAGAVGAVLVDDLEKAVATAYIDFPVTEITSNAAADIHKYISSTSEPVATITPTITVTEYKPAPVVAYFSSRGPSPQTPNILKPDVAAPGVNILASWIPTSTLPAGEEKPSQFNLVSGTSMACPHVAGAAAAVRAWNPAWSPAAIRSAIMTTAAQLNNDGAAVTTDSGSPATPYDHGAGQVNPAAALDAGLVYELGEEDYLQFLCDYGYDASQIKLVAASLPGGFSCGAGGNASDSKDLISGLNYPSIAVTGLGKAGGTRTVSRVVTNVGAQQEATYTVAVAAPAGLDVKVVPGKLEFTKSVKKLGFQVSFSGKNAAAAAKGDLFGSITWSDGKHTVRSPFVVTI

SEQ ID NO: 23 - protein, 788 aa, Oryza sativa
MVNRAHFVILVLVYRLLVPLSAEPDQTRESYVVYMGGGGGAGAGVEEEAARAMHMEMLTSVAPAGDDQGRAAAALTQSYHHAFQGFAAELTEAEAAALSGHERVVSVFRDRALELHTTRSWDFLDVQSGLRSDRLGRRASGDVIIGIVDTGVWPESASFSDAGMGPVPARWRGVCMEGPDFKKSSCNKKLIGARYYSSQPGSASSSSAAGAVTATGGSPRDAVGHGTHTASTAAGAVVPGAGYYGLARGAAKGGAPASRVAVYKACSLGGCASSAVLKAIDDAVGDGVDVVSISIGMSSAFQSDFLADPIALGAFHAHQRGVLVVCSGGNDGPNPYTVVNSAPWILTVAASSIDRSFHSTIVLGNGTLVKGIAINFSNQSITGGQYPLVFGPQVAGRYTPVSEASNCYPGSLDAQKAAGKIVVCVGTDPMVSRRVKKLVAEGAGASGLVLIDDAEKAVPFVAGGFPFSQVATDAGAQILEYINSTKNPTAVILPTEDAKDDKPAPVVASFSARGPGGLTEAILKPDLMAPGVSILAATIPTADKEDVPAGKNPSPFAIKSGTSMACPHVAGAAAFVKSAHPGWSPSMIRSALMTTATTRNNLGQAVASSTGAAATGHDMGAGEISPLRALSPGLVFDTTTRDYLNFLCYYGYKEQLVRKLAGAGAAGAAFACPRGAPSPDLIASGVNYPSISVPRLLAGRTATVSRVAMNVGPPNATYAAAVEAPPGLAVKVSPERLVFSSRWTTAAYQVSFEIAGAGAGASKGYVHGAVTWSDGAHSVRTPFAVNVI

SEQ ID NO: 24 - protein, 795 aa, Oryza sativa
MVNRAHFVILVLVYRLLVPLSAEPDQTRESYVVYMGGGGGGAGAGAGVEEEAARAMHMEMLTSVAPAGDDQGRAAAALTQSYHHAFQGFAAELTEAEAAALSGHERVVSVFRDRALELHTTRSWDFLDVQSGLRSDRLGRRASGDVIIGIVDTGVWPESASFSDAGMGPVPARWRGVCMEGPDFKKSSCNKKLIGARYYGSQPGSASSSSAAGAVTATGGSPRDAVGHGTHTASTAAGAVVPGAGYYGLARGAAKGGAPASRVAVYKACSLGGCASSAVLKAIDDAVGDGVDVVSISIGMSSAFQSDFLADPIALGAFHAHQRGVLVVCSGGNDGPNPYTVVNSAPWILTVAASSIDRSFHSTIVLGNGTLVKGIAINFSNQSITGGQYPLVFGPQVAGRYTPVSEASNCYPGSLDAQKAAGKIVVCVGTDPMVSRRVKKLVAEGAGASGLVLIDDAEKAVPFVAGGFPFSQVATDAGAQILEYINSTKNPTAVILPTEDAKDDKPAPVVASFSARGPGGLTEAILKPDLMAPGVSILAATIPTADKEDVPAGKNPSPFAIKSGTSMACPHVAGAAAFVKSAHPGWSPSMIRSALMTTATTRNNLGQAVASSTGAAATGHDMGAGEISPLRALSPGLVFDTTTRDYLNFLCYYGYKEQLVRKLAGAGAAGAAFACPRGAPSPDLIASGVNYPSISVPRLLAGRTATVSRVAMNVGPPNATYAAAVEAPPGLAVKVSPERLVFSSRWTTAAYQVSFEIASGGAGAGAGASKGYVHGAVTWSDGAHSVRTPFAVNVI

SEQ ID NO: 25 - protein, 769 aa, Oryza sativa
MAMSPLLFIVFLLMLLEPCSSSRSNVYIVYMGERHHGLRPELVQEAHHGMLAAVLGSEQAAMDAILYSYRHGFSGFAAVLTGGQAARLSDWPGVVRVVRNRVLDLHTTRSWDFMGVNPSPSGGGILLESRFGEDSIIGVLDTGIWPESASFRDDGIGEVPRRWKGQCVAGEKFNASNCNRKIIGAKWYVKGYEAEYGKMNTSDIYEFMSARDAVGHGTHTASTAAGALVANASFRGLAKGVARGGAQRARLAVYKVCWATGDCTAADILAAFDDAIHDGVDVISVSLGQAPPLPAYVDDVLSIGSFHAVAKGVVVVCSAGNSGPYSETVINSAPWIVTVAAGTIDRIFLAKIILGNNSTYVGQTLYSGKHPSKSVRIVYAEDISSDNADDTDARSCTAGSLNATLVKGNVVLCFQTRAQRSASVAVETVKKARGVGVIFAQFLTKDIASSLDIPCVQVDYQVGTAILAYTTSMRNPVAQFSFPKTIVGELVAPEVAYFSSRGPSSLSPSILKPDIAAPGVNILAAWSPAAAISSAIGSVNFKIDSGTSMSCPHISGVVALLKSMHPNWSPAAVKSALVTTANVHDAYGFEMVSEAAPYNDANPFDYGGGHVNPNRAAHPGLVYDMGVSDYMRFLCSMGYNTSAISSMTQQQTTCQHTPKSQLNLNVPSITIPELRGKLTVSRTVTNVGPALSKYRARVEAPPGVDVTVSPSLLTFNSTVRKLPFKVTFQAKLKVKGRYTFGSLTWEDGTHTVRIPLVVRIIISKFYVNA

SEQ ID NO: 26 - protein, 769 aa, Oryza sativa
MAMSPLLFIVFLLMLLEPCSSSRSNVYIVYMGERHHGLRPELVQEAHHGMLAAVLGSEQAAMDAILYSYRHGFSGFAAVLTGGQAARLSDWPGVVRVVRNRVLDLHTTRSWDFMGVNPSPSGGGILLESRFGEDSIIGVLDTGIWPESASFRDDGIGEVPRRWKGQCVAGEKFNASNCNRKIIGAKWYVKGYEAEYGKMNTSDIYEFMSARDAVGHGTHTASTAAGALVANASFRGLAKGVARGGAQRARLAVYKVCWATGDCTAADILAAFDDAIHDGVNVISVSLGQAPPLPAYVDDVLSIGSFHAVAKGVVVVCSAGNSGPYSETVINSAPWIVTVAAGTIDRIFLAKIILGNNSTYVGQTLYSGKHPSKSVRIVYAEDISSDNADDTDARSCTAGSLNATLVKGNVVLCFQTRAQRSASVAVETVKKARGVGVIFAQFLTKDIASSLDIPCVQVDYQVGTAILAYTTSMRNPVAQFSFPKTIVGELVAPEVAYFSSRGPSSLSPSILKPDIAAPGVNILAAWSPAAAISSAIGSVNFKIDSGTSMSCPHISGVVALLKSMHPNWSPAAVKSALVTTANVHDAYGFEMVSEAAPYNDANPFDYGGGHVNPNRAAHPGLVYDMGVSDYMRFLCSMGYNTSAISSMTQQQTTCQHMPKSQLNLNVPSITIPELRGKLTVSRTVTNVGPALSKYRARVEAPPGVDVTVSPSLLTFNSTVRKLPFKVTFQAKLKVQGRYTFGSLTWEDGTHTVRIPLVVRIIISKFYVNA

SEQ ID NO: 27 - protein, 523 aa, Oryza sativa
CSGEGCAGSAILAGFDDAVADGVDVISVSLGASPYFRPDFSDDPIAIGSFHAVAKGIMVVCSAGNAGPDAATVVNAAPWILTVAASTIDRYFQSDVVLGGNNTAVKGGAINFSNLNKSPKYPLITGESAKSSSVSDTESASHCEPGTLDASKIKGKIVLCHHSRNSDTPKTEKVGELKSAGAVGAVLVDDLEKAVATAYIDFPVTEITSNAAADIHKYISSTSEPVVTITPTITVTEYKPAPVVAYFSSRGPSPQTPNILKPDVAAPGVNILASWIPTSTLPAGEEKPSQFNLVSGTSMACPHVAGAAAAVRAWNPAWSPAAIRSAIMTTAAQLNNDGAAVTTDSGSPATPYDHGAGQVNPAAALDAGLVYELGEEDYLQFLCDYGYDASQIKLVAASLPGGFSCGAGGNASDSKDLISGLNYPSIAVTGLGKAGGTRTVSRVVTNVGAQQEATYTVAVAAPAGLDVKVVPGKLEFTKSVKKLGFQVSFSGKNAAAAAKGDLFGSITWSDGKHTVRSPFVVTI

SEQ ID NO: 28 - protein, 791 aa, Oryza sativa
MAAAAIVVLLVCSLPSLLVGAAAAGGGEKQSYVVYLGEHAHGERLGAAAAADVDVEALARQAEDSHCELLAGVLGDKEKAREAIFYSYTRHINGFAANLDAAAAAKIAEKPGVVSVFPNRGHKLHTTRSWQFLGLAGVGGAPTGAAWKKARFGEDTIIGNLDTGVWPESESFRDDGLGPIPSWWRGECQKGQDDAFSCNRKLIGARFFNKGYASAVGNLNTSLFDTPRDTDGHGTHTLSTAGGAPVAGASVFGYGNGTASGGSPMARVAAYRVCYTPVNGSECFDADILAAFDAAIHDGVHVLSVSLGGDAGDYFADGLAIGSFHAVRHGIAVVCSAGNSGPAPGTVSNVAPWLFTAAASTMDREFPAYVVFNDTKLKGQSLSASALSPASSSFPMIDSSLAASPNRTQNESQLCFLGSLDPEKVKGKIVVCLRGVNPRVEKGEAVLEAGGAGMVLANDVTTGNEIIADAHVLPATHIKFSDGQILFSYLKNTKSPAGTITRPETRLGTKPAPFMAAFSSQGPNTVTPGILKPDITAPGVSVVAAWTRASAPTDLAFDKRRVAFNSESGTSMSCPHVAGVVGLLRTLRPDWSPAAIRSALMTTAVEVDNERHAILNSSFAAANPFGFGAGHVSPARAMNPGLVYDLAAVDYLNFLCSLRYNATVMAMFAGGGGAAPFRCPASPPKVQDLNYPSITVVNLTSSATVRRTVKNVGKPGVYKAYVTSPAGVRVTVSPDTLPFLLKGEKKTFQVRFEVTNASLAMDYSFGALVWTNGKQFVRSPLVVKTTTPTMA

SEQ ID NO: 29 - protein, 799 aa, Oryza sativa
MAAAAIVVLLVCSLPSLLVCSLPSLLVGAAAAGGGEKQSYVVYLGEHAHGERLGAAAAADVDVEALARQAEDSHCELLAGVLGDKEKAREAIFYSYTRHINGFAANLDAAAAAKIAEKPGVVSVFPNRGHKLHTTRSWQFLGLAGVGGAPTGAAWKKARFGEDTIIGNLDTGVWPESESFRDDGLGPIPSWWRGECQKGQDDAFSCNRKLIGARFFNKGYASAVGNLNTSLFDTPRDTDGHGTHTLSTAGGAPVAGASVFGYGNGTASGGSPMARVAAYRVCYTPVNGSECFDADILAAFDAAIHDGVHVLSVSLGGDAGDYFADGLAIGSFHAVRHGIAVVCSAGNSGPAPGTVSNVAPWLFTAAASTMDREFPAYVVFNDTKLKGQSLSASALSPASSSFPMIDSSLAASPNRTQNESQLCFLGSLDPEKVKGKIVVCLRGVNPRVEKGEAVLEAGGAGMVLANDVTTGNEIIADAHVLPATHIKFSDGQILFSYLKNTKSPAGTITRPETRLGTKPAPFMAAFSSQGPNTVTPGILKPDITAPGVSVVAAWTRASAPTDLAFDKRRVAFNSESGTSMSCPHVAGVVGLLRTLRPDWSPAAIRSALMTTAVEVDNERHAILNSSFAAANPFGFGAGHVSPARAMNPGLVYDLAAVDYLNFLCSLSYNATVMAMFAGGGGAAPFRCPASPPKVQDLNYPSITVVNLTSSATVRRTVKNVGKPGVYKAYVTSPAGVRVTVSPDTLPFLLKGEKKTFQVRFEVTNASLAMDYSFGALVWTNGKQFVRSPLVVKTTTPTMA

SEQ ID NO: 30 - protein, 805 aa, Oryza sativa
MCSSLKNHPPAPLLALALLIGSLVLLQRPAYAEKKSFVVYLGGHSHGRGGAALASSQERAKNSHHEFLGSFLGSKEKARDAIFYSYTKYINGFAATLEEEEAMEISKHPSVISVFPNRGHRLHTTRSWEFLGMEKDGRIRANSIWAKARFGEGVIIGNLDTGVWPEAGSFSDDGMGPAPVRWRGICQDQASDDAQVPCNRKLIGARYFNKGYLSTVGQAANPASTRDTDGHGTHTLSTAAGRFVPGANLFGYGNGTAKGGAPGAHVAAYKVCWRPVNGSECFDADIIAAFDAAIHDGVDVLSVSLGGAPAGYLRDGVAIGSFHAVRRGVTVVCSAGNSGPGAGTVSNTAPWLVTVGASTMDREFPAYLVLGNNKKIKGQSLSPVRLAGGKNYPLISSEQARAANATASQARLCMEGSLERGKVEGRIVVCMRGKNARVEKGEAVRRAGGAGLVLANDEATGNEMIADAHVLPATHVTYSDGVALLAYLNSTRSPSGFITVPDTALDTKPAPFMAAFSSQGPNTVTTQILKPDITAPGVSILAAFTGQAGPTGLAFDSRRVLFNAESGTSMSCPHVAGVAGLLKALHPDWSPAAIKSAIMTTARVKDNMRRPMSNSSFLRATPFSYGAGHVQPGRAADPGLVYDMNDTDYLGFLCALGYNSSVIATFMASGSGAQPPYACPPARRPEDLNYPSFALPHLSPSGAARTVTRRVRNVGAAPAAYVASVAEPRGVSVAVRPSRLEFTAAGEELEFAVTFRAKKGSFLAGEYEFGRLVWSDAAAGGRHRVRSPLVVRVVDKKGKNGLPIS

SEQ ID NO: 31 - protein, 778 aa, Oryza sativa
MATSSLLFLLVLSSFSTASAAFTKPRQVYVVYLGEHAGAKVEEEILAGHHGLLLSVKGSEEEARASLLYSYKHSLNGFAALLSEEEATALSARTEVVSAFPSNGRWSPHTTRSWEFVGLEEGVRGPDDTGRLPPGDKAGGEDVIVGVLDSGIWPESRSFGDEGLGPVPARWKGVCQGGDSFSPSSCNRKIIGARYYVKAYEARYGAVNTTNAYRSPRDHDGHGTHTASTVAGRTVPGVAALGGFAPGTASGGAPLARVAVYKVCWPIPGPNPNIENTCFEADMLAAIDDAVGDGVDVMSVSIGSTGKPLPFAEDGIAVGALHAAMRGVVLVCSGGNSGPKPATVSNLAPWMLTVAASSIDRAFISPIKLGNGMVIMGQTVTPYQLPGNKPYPLVYAADAVVPGTPANVSNQCLPKSLAPEKVRGKIVVCLRGTGLRVEKGLEVKQAGGAAIILGNPPAFGGEVPVDAHVLPGTAVSSVDVNSIIRYINSSSSPTAVLDPSRTVVDVKPSPVMAQFSSRGPNVNEPNILKPDVTAPGLNILAAWSEASSPTKLDGDNRVVKYNIMSGTSMSCPHVSATAVLLKSAHPGWSSAAIRSAIMTTATTSNAEGGPMMDADGTVAGPIDYGSGHIRPKHALDPGLVYDASYQDYLLFACASGGAQLDHSLPCPATPPPPYQLNHPSLAIHGLNGSVTVQRTVTNVGQGSARYSVAVVEPMGVSVKVSPRSLSFARTGEKKSFRIKIEATKGRGGWRVNGQFVAGSYTWSDGVHVVRSPLVVLVA

SEQ ID NO: 32 - protein, 778 aa, Oryza sativa
MATSSLLFLLVLSSFSTASAAFTKPRQVYVVYLGEHAGAKVEEEILAGHHGLLLSVKGSEEEARASLLYSYKHSLNGFAALLSEEEATALSARTEVVSAFPSNGRWSPHTTRSWEFVGLEEGVRGPDDTGRLPPGDKAGGEDVIVGVLDSGIWPESRSFGDEGLGPVPARWKGVCQGGDSFSPSSCNRKIIGARYYVKAYEARYGAVNTTNAYRSPRDHDGHGTHTASTVAGRTVPGVAALGGFAPGTASGGAPLARVAVYKVCWPIPGPNPNIENTCFEADMLAAIDDAVGDGVDVMSVSIGSTGKPLPFAEDGIAVGALHAAMRGVVLVCSGGNSGPKPATVSNLAPWMLTVAASSIDRAFISPIKLGNGMVIMGQTVTPYQLPGNKPYPLVYAADAVVPGTPANVSNQCLPKSLAPEKVRGKIVVCLRGTGLRVEKGLEVKLAGGAAIILGNPPAFGGEVPVDAHVLPGTAVSSVDVNAIIRYINSSSSPTAVLDPSRTVVDVKPSPVMAQFSSRGPNVNEPNILKPDVTAPGLNILAAWSEASSPTKLDGDNRVVKYNIMSGTSMSCPHVSATAVLLKSAHPGWSSAAIRSAIMTTATTSNAEGGPMMDADGTVAGPIDYGSGHIRPKHALDPGLVYDASYQDYLLFACASGGAQLDHSLPCPATPPPPYQLNHPSLAIHGLNGSVTVQRTVTNVGQGSARYSVAVVEPMGVSVKVSPRSLSFARTGEKKSFRIKIEATKGRGGWRVNGQFVAGSYTWSDGVHVVRSPLVVLVA

SEQ ID NO: 33 - protein, 765 aa, Oryza sativa
MMRLLLVAVAVAMAAVVVAAEERATYIVHMAKSAMPAEYGDDHGEWYGASLRSVSGAGKMLYAYDTVLHGFSARLTAREARDMAAMDGVLAVNPEARYELHTTRTPEFLGIAGNDGLFPQSGTAGDVVVGVLDTGVWPESRSYDDAGLGEVPSWWKGECMAGTGFNSSACNRKLVGARFFNRGYEAAMGPMDTTRESRSPRDDDGHGTHTSSTAAGAAVSGASLLGFASGTARGMAPRARVAVYKVCWLGGCFSSDILAGMDAAVADGCGVLSLSLGGGAADYARDSVAIGAFAAMEQNVLVSCSAGNAGPGTSTLSNVAPWITTVGAGTLDRDFPAYVSLGNGKNYTGVSLYAGKALPSTPLPIVYAANASNSTAGNLCMPGTLTPEKVAGKIVVCDRGVSARVQKGFVVRDAGGAGMVLSNTATNGEELVADAHLLPAAGVGAKEGAAIKAYVASDPSPTATIVVAGTQVDVRPSPVVAAFSSRGPNMLTPEILKPDIIAPGVNILAAWTGKAGPTGIAADTRRVAFNIISGTSMSCPHVSGLAALLRSAHPEWSPAAVRSALMTTAYSTYAGAGDANPLLDAATGAPATPFDYGAGHVDPASAVDPGLVYDLGTADYVDFLCALNYTSTMIAAVARSKSYGCTEGKAYSVYNLNYPSFAVAYSTASSQAAESSGAAATTVTHRRTLTNVGAAGTYKVSAAAMPGVAVAVEPTELAFTSAGEKKSYTVSFTAKSQPSGTAGFGRLVWSDGKHSVASPMAFTWT

SEQ ID NO: 34 - protein, 800 aa, Oryza sativa
MGLKHTSNLKSASCQDRDNMIFLVFYVFVVLLGEFCSSCSCAQVYVVYMGKGLQGSTENRHDRLRLHHQMLTAVHDGSLTNWMLGLSMEKAEASHVYTYSNGFQGFAAKLNKQQAMKLANMPGVISVFPNTKRSLHTTHSWDFMGLSVDAAAELPELSSKNQENVIIGFIDTGIWPESPSFRDHGMPPVPTRWRGQCQRGEANSPSNFTCNRKIIGGRYYLRGYQTEESGQSRSAIKFISPRDSSGHGSHTASIAAGRFVRNMNYRGLGTGGGRGGAPMARIAAYKTCWDKGCYDADILAAFDDAIADGVDIISVSLGPDYPQGGYFTDAISIGSFHATSNGILVVSSAGNAGRKGSATNLAPWILTVAAGTTDRSFPSYIRLANGTLIMGESLSTYHMHTSVRTISASEANASSFTPYQSSFCLDSSLNRTKARGKILICHRAKGSSDSRVSKSMVVKEAGALGMILIDEMEDHVANHFALPATVVGKATGDKILSYISSIRFSAKYCSYFQKGCGSTMILPAKTILGSRDAPRVAAFSSRGPNSLTPEILKPDIAAPGLNILAAWSPAKEDKHFNILSGTSMACPHVTGIAALVKGAYPSWSPSAIKSAIMTTANVLGNKRNAIATDPNGRTATPFDFGSGFADPIKALNPGIIFDAHPEDYKSFLCSIGYDDHSLHLITQDNSSCTDRAPSSAAALNYPSITIPNLKKSYSVTRTMTNVGFRGSAYHAFVSAPLGINVTVTPKVLVFENYGAKKTFTVNFHVDVPQRDHVFGSLLWHGKDARLMMPLVVKVDTAAKA

SEQ ID NO: 35 - protein, 1009 aa, Oryza sativa
MEIATYRFKDQRTSRIISRTPMEVAVREIATYRFEDQRTSRIISRTPMEVAVRKIATYWFENQRASRIFSRTPMEVAVREIATHWFENQRASRIISRTPMEVAVREIATYWFENQRASRIISRTPMENYGCLSLSGTPPISAGCFRIGHGWEKRAVARALKQRYTLRRFSRAFWNLEGISFSLVSQENSEHPFFRKSGNLHGSQTHIEPEKCQLPGKCATHEDEDRDNMIFLVFYVFVVLLGEFCSSCSCAQVYVVYMGKGLQGSTENRHDMLRLHHQMLTAVHDGSLTNWMLGLSMEKAEASHVYTYSNGFQGFAAKLNKQQAMKLANMPGVISVFPNTKRSLHTTHSWDFMGLSVDAAAELPELSSKNQENVIIGFIDTGIWPESPSFRDHGMPPVPTRWRGQCQRGEANSPSNFTCNRKIIGGRYYLRGYQTEESGQSRSAIKFISPRDSSGHGSHTASIAAGRFVRNMNYRGLGTGGGRGGAPMARIAAYKTCWDSGCYDADILAAFDDAIADGVDIISVSLGPDYPQGGYFTDAISIGSFHATSNGILVVSSAGNAGRKGSATNLAPWILTVAAGTTDRSFPSYIRLANGTLIMGESLSTYHMHTSVRTISASEANASSFTPYQSSFCLDSSLNRTKARGKILICHRAKGSSDSRVSKSMVVKEAGALGMILIDEMEDHVANHFALPATVVGKATGDKILSYISSTRFSAKYCSYFQKGCGSTMILPAKTILGSRDAPRVAAFSSRGPNSLTPEILKPDIAAPGLNILAAWSPAKEDKHFNILSGTSMACPHVTGIAALVKGAYPSWSPSAIKSAIMTTATVLGNKRNAIATDPNGRTATPFDFGSGFADPIKALNPGIIFDAHPEDYKSFLCSIGYDDHSLHLITQDNSSCTDRAPSSAAALNYPSITIPNLKKSYSVTRTMTNVGFRGSAYHAFVSAPLGINVTVTPKVLVFENYGAKKTFTVNFHVDVPQRDHVFGSLLWHGKDARLMMPLVVKVDTAAKA

SEQ ID NO: 36 - protein, 764 aa, Oryza sativa
MWRHGERCVILAVAAVALVAAATATAAAAVGGERRTYIVHMSRSAKPNDFVEHGEWYAASLQSVSDAATVLYTYDTIVHGYSARLTRAEAEALESQPGVLLVNPEVRYELHTTRTPEFLGLDRTDALFPQSNTGSDVIVGVLDTGVWPERPSYDDAGLGPVPAGWKGKCEEGNDFNASACNKKLIGARFFLTGYEAAKGPVDTSKESRSPRDNDGHGTHTSSTAAGSAVRGADLLGYAAGTAKGMAPHARVATYKVCWVGGCFSSDILKAMEVAVNDGVDVLSLSLGGGTADYYRDSIAVGAYSAMERGIFVSCSAGNAGPGSATLSNGAPWITTVGAGTLDRDFPAHVVLGNGKNYSGVSLYSGKQLPTTPVPFIYAGNASNSSMGALCMSGSLIPEKVAGKIVLCDRGTNARVQKGFVVKDAGGAGMVLANTAANGEELVADAHVLPGAGVGQKAGDTMRAYALSDPNPTASIVFAGTQVGIQPSPVVAAFSSRGPNTVTPGILKPDLIAPGVNILAAWSGSVGPSGLAGDSRRVGFNIISGTSMSCPHVSGLAALLRAAHQDWSPAAIRSALMTTSYNGYPNGNGILDVATGLPATPLDVGAGHVDPSKAVDPGLVYDIAAADYVDFLCAISYGPMQIAALTKHTTDACSGNRTYAVTALNYPSFSVTFPATGGTEKHTRTVTNVGQPGTYKVTASAAAGSTPVTVSVEPSTLTFTKSGEKQSYTVSFAAAAMPSGTNGFGRLVWSSDHHVVSSPIAVTWT

SEQ ID NO: 37 - protein, 762 aa, Oryza sativa
MASSRLFLAAALLETNWPYIVYLGSHPYGPDASAEEHARATQSHHDLLGSVLGSKQLAKDAILYSYTKNINGFAAHLEEEVATQIARHPDVVTVMASTMLKLHTTRSWDFMDMERDGQILPDSIWKHGRFGQDVIIANLDSGVWPESNSFTDEEVVGEVPKRWKGSCSDTAKYGVSCNKKLIGARYFNKDMLLSNPGAVDGNWSRDTEGHGTHTLSTAGGRFVPRASLFGYANGTAKGGAPRARVAAYKVCWSGECAAADVLAGFEAAIHDGADVISVSFGQDAPVATVASFLQEPVTLGSLHAAMNGVSVVCSAGNSGPLEDTVVNAAPWVTTVAASTVDRDFPNVVTLGNNAHMTGMSLETTTLHSTQLYSMIKASDAALASSDPAVASTCPPGTLDPEKVKNKIVVCVRGGDIPRVTKGMTVLNAGGTGMILANGEMDGDDIVADPHVLPATMITYSEAMSLYKYMDSSKNPVANISPSKTEVGVKNSPSVAAFSSRGPSGTLPCVLKPDIAAPGVDILAAFTEYVSPTEVPNDERRSEYAILSGTSMACPHISGVIGLLKAARPEWSPAAMRSAIMTTARTQDNTGAPMRDHDGREATAFAFGAGNIHPNRAVDPGLVYDLSKEDYFVFLCSMGFNSSDLAKLSAGNFTCPEKVPPMEDLNYPSIVVPALRHTSTVARRLKCVGRPATYRATWRAPYGVNMTVEPAALEFGKDGEVKEFKVTFKSEKDKLGKGYVFGRLVWSDGTHHVRSPVVVNALD

SEQ ID NO: 38 - protein, 780 aa, Oryza sativa
MAAAPHCLLLLLVLIPTLLRGVVGGSGAGGEARKTYIFRVDHSAKPSVFPSHAHWYSSAAFASGADGAPLEPLHVYDTVFHGFAASVPASRADALRRHPAVLAAFEDQVRTLHTTRSPQFLGLRARLGLWSLADYGSDVVVGVLDTGVWPERRSLSDRNLPPVPSRWRGGCDAGPGFPASSCNRKLVGARFFSQGHAAHYGLAATASNGSVEFMSPRDADGHGTHTATTAAGSVAYDASMEGYAPGVAKGVAPKARVAAYKVCWKGAGCLDSDILAGFDRAVADGVDVISVSIGGGNGVASPFYLDPIAIGAYGAVSRGVFVATSAGNEGPTAMSVTNLAPWLATVGAGTIDRNFPAEIVLGDGRRMSGVSLYSGKPLTNTMLPLFYPGRSGGLSASLCMENSIDPSVVSGKIVICDRGSSPRVAKGMVVKDAGGVAMVLANGAANGEGLVGDAHVLPACSVGENEGDTLKAYAANTTNPTATINFKGTVIGVKPAPVVASFSARGPNGLVPEILKPDFIAPGVNILAAWTGATGPTGLESDPRRTEFNILSGTSMACPHASGAAALLRSAHPGWSPAAIRSALMTTAVATDNRGEAVGDEAEPGRVATPFDYGAGHINLGKALDPGLVYDIGDDDYVAFMCSIGYEANAIEVITHKPVACPATSRNPSGSDLNYPSISVVFYGGNQSKTVIRTATNVGAAASATYKPRVEMASSAVSVTIKPEKLVFSPTAKTQRFAVTVASSSSSPPASAPVYGHLVWSDGGGHDVRSPIVVTWLQSM

SEQ ID NO: 39 - protein, 776 aa, Oryza sativa
MDFCKARWKVPALCLVTVLLQASLSACAPTPKTYIVQMAASEMPSSFDFYHEWYASTVKSVSSSQLEDEEDDASTRIIYNYETAFHGFAAQLDEEEAELMAEADGVLAVIPETVLQLHTTRSPDFLGIGPEVSNRIWSDSLADHDVVVGVLDTGIWPESPSFSDKGLGPVPAKWKGLCQTGRGFTTANCNRKIVGARIFYNGYEASSGPINETTELKSPRDQDGHGTHTAATAAGSPVQDANLYGYAGGVARGMAPRARVAAYKVCWAGGCFSSDILAAVDRAVSDGVDVLSISLGGGASRYYLDSLSIASFGAMQMGVFVACSAGNAGPDPISLTNLSPWITTVGASTMDRDFPATVTLGNGANITGVSLYKGLRNLSPQEQYPVVYLGGNSSMPDPRSLCLEGTLQPHDVSGKIVICDRGISPRVQKGQVVKEAGGIGMILANTAANGEELVADSHLLPAVAVGEAEGIAAKSYSKSAPKPTATLSFGGTKLGIRPSPVVAAFSSRGPNILTLEILKPDVVAPGVNILAAWSGDASPSSLSSDSRRVGFNILSGTSMSCPHVAGVAALIKASHPDWSPAQIKSALMTTAYVHDNTYRPMKDAATGKASTPFEHGAGHIHPVRALTPGLVYDIGQADYLEFLCTQHMTPMQLRTFTKNSNMTCRHTFSSASDLNYPAISVVFADQPSKALTVRRTVTNVGPPSSTYHVKVTKFKGADVIVEPNTLHFVSTNQKLSYKVTVTTKAAQKAPEFGALSWSDGVHIVRSPVVLTWLPPQ

SEQ ID NO: 40 - protein, 766 aa, Solanum esculentum
MERLRLMFLLILMVVLFHVFVDARQNQKKTYIIHMDKFNMPADFDDHTQWYDSSLKSVSKSANMLYTYNSVIHGYSTQLTADEAKALAQQPGILLVHEEVIYELHTTRSPTFLGLEGRESRSFFPQTEARSEVIIGVLDTGVWPESKSFDDTGLGQVPASWKGKCQTGKNFDASSCNRKLIGARFFSQGYEAAFGAIDETIESKSPRDDEGHGTHTATTAAGSVVTGASLLGYATGTARGMASHARVAAYKVCWTGGCFSSDILAGMDQAVIDGVNVLSLSLGGTISDYHRDIVAIGAFSAASQGIFVSCSAGNGGPSSGTLSNVAPWITTVGAGTMDREFPAYIGIGNGKKLNGVSLYSGKALPSSVMPLVYAGNVSQSSNGNLCTSGSLIPEKVAGKIVVCDRGMNARAQKGLVVKDAGGIGMILANTDTYGDELVADAHLIPTAAVGQTAGNLIKQYIASNSNPTATIAFGGTKLGVQPSPVVAAFSSRGPNPITPDVLKPDLIAPGVNILAGWTGKVGPTGLQEDTRNVGFNIISGTSMSCPHVSGLAALLKAAHPEWSPAAIRSALMTTSYSTYKNGKTIEDVATGMSSTPFDYGAGHVNPTAAVSPGLVYDLTVDDYINFLCALDYSPSMIKVIAKRDISCDENKEYRVADLNYPSFSIPMETAWGEHADSSTPTVTRYTRTLTNVGNPATYKASVSSETQDVKILVEPQTLTFSRKNEKKTYTVTFTATSKPSGTTSFARLEWSDGQHVVASPIAFSWT

SEQ ID NO: 41 - protein, 775 aa, Solanum esculentum
MAGMLLKCMFFFVSVCLAINLAKCSPNTKKTYIIQMDKWAKPDVFVDHVQWYSSLVKSVLPSTTEVEKTGDGEERILYSYQTAFHGVAAQLSEEEVKKLQERNGVLAVFPEIKYQLHTTRSPLFLGLDREDSSKLWADRLSDHNVIVGVLDTGIWPESPSFNDSGMTSVPSHWKGVCETGRGFEKHHCSKKIVGARVFFRGYEAASGKINERGEFKSARDQDGHGTHTAGTVAGSVVRGANLLGYAYGTARGMAPGARVAAYKVCWVGGCFSSDILSAVDQAVADGVNILSISLGGGVSSYNRDSLSIAAFGAMEKGVFVSCSAGNGGPDPISLTNVSPWITTVGASTMDRDFPATVELGTGKIVTGASLYKGRMNLSTQKQYPLIYLGSNSSNLMPSSLCLDGTLDKASVAGKIVICDRGISPRVQKGQVVKEAGGVGMILTNTAANGEELVADSHLLPAVAVGEREGRAIKLYAAGRSATATLRFLGTKLGIRPSPVVAAFSSRGPNFLSLEILKPDMVAPGVNILAGWTGALGPSSLPIDQRRTNFNILSGTSMSCPHVSGIAALLKARHPDWSPAAIKSALMTTAYVHDNTYKSLKDASSVTPSTPYDHGAGHVNPRKAVDPGLIYDIGAQDYFEFLCTQELSPSQLMVFGKFSNRTCHHSLANPGDLNYPAISAVFPEKTKLSMLTLHRTVTNVGSPISNYHVVVSAFKGAVVKVEPERLNFTSKNQKLSYKVTFKTVSRQKAPEFGSLIWKDGTHKVRSPIAITWLASV

SEQ ID NO: 42 - protein, 745 aa, Solanum esculentum
MGLLKILLVFIFCSFQWPTIQSNLETYIVHVESPESLVTTQSLLTDLGSYYLSFLPKTATTISSSGNEEAATMIYSYHNVMTGFAARLTAEQVKEMEKKHGFVSAQKQRILSLHTTHTPSFLGLQQNMGVWKDSNYGKGVIIGVIDTGIIPDHPSFSDVGMPPPPAKWKGVCESNFTNKCNNKLIGARSYQLGNGSPIDSIGHGTHTASTAAGAFVKGANVYGNADGTAVGVAPLAHIAIYKVCNSVGCSESDVLAAMDSAIDDGVDILSMSLSGGPIPFHRDNIAIGAYSATERGILVSCSAGNSGPSFITAVNTAPWILTVGASTLDRKIKATVKLGNGEEFEGESAYRPKISNATFFTLFDAAKNAKDPSETPYCRRGSLTDPAIRGKIVLCSALGHVANVDKGQAVKDAGGVGMIIINPSQYGVTKSADAHVLPALVVSAADGTKILAYMNSTSSPVATIAFQGTIIGDKNAPMVAAFSSRGPSRASPGILKPDIIGPGANILAAWPTSVDDNKNTKSTFNIISGTSMSCPHLSGVAALLKCTHPDWSPAVIKSAMMTTADTLNLANSPILDERLLPADIYAIGAGHVNPSRANDPGLVYDTPFEDYVPYLCGLKYTDQQVGNLIQRRVNCSEVKSILEAQLNYPSFSIFGLGSTPQTYTRTVTNVGDATSSYKVEVASPEGVAIEVEPSELNFSELNQKLTYQVTFSKTTNSSNPEVIEGFLKWTSNRHSVRSPIAVVSA

SEQ ID NO: 43 - protein, 743 aa, Solanum esculentum
MMPQYSSILTIFGLICVLFLFSTNATEQNNSQIYIVHCEFPSGERTSKYQDLESWYLSFLPATTSDSSREAPRLIYSYRNVLTGFAAKLSQEDIKEMEKMEGFVSARPQRLLKLHTTHSVDFLGLQQNMGFWKDSNYGKGVIIGVIDSGVFPDHPSFSDVGMPPIPAKWKGVCESDFATKCNNKLIGARSYQIANGSPIDNDGHGTHTAGTTAGAFVEGANGSSGNANGTAVGVAPLAHIAIYKVCNSNSCSDSDILAAMDSAIEYGVDILSMSLGGSPVPFYEDSIAFGAYAATERGILVSCSAGNSGPSYITASNTAPWILTVGASTIDRKIKATVTLGNTEEFEGESAYRPQISDSTYFTLYDAAKSIGDPSEPYCTRSLTDPAIKKIAICQAGDVSNIEKRQAVKDAGGVGMIVINHHIYGVTKSADAHVLPGLVVSAADGSKILDYTNSISNPIATITIQGTIIGDKNAPIVAAFSSRGPSKPNPGILKPDIIGPGVNILAAWPTSVDDNKDTKSTFNIISGTSMSCPHLSGIAALLKSTHPDWSPAAIKSAIMTTAYTLNLDSSPILDERLLPADIFAIGAGHVNPSSANDPGLVYDTPSEDYFPYLCGLGYTNAQVSSLLRRTVNCLEVNSIPEAQLNYPSFSIYGLGSTPQTYTRTVTNVGDATSSYKVKIASLIGVAVEVVPTELNFSELNQKLTYQVTFSKTTSSSEVVVVEGFLKWTSTRHSVRSPIAVVLV

SEQ ID NO: 44 - protein, 746 aa, Solanum esculentum
MMAQYSSVLTIIGLICVLFSFTTHAAEQNNSQIYIVHCEFPSGERTAEYQDLESWYLSFLPTTTSVSSREAPRLIYSYRNVLTGFAAKLSEEDIKEMEKKEGFVSARPQQFVSLHTTHSVNFLGLQQNMGFWKDSNYGKGVIIGVLDTGILPDHPSFSDVGMPTPPAKWKGVCESNFMNKCNKKLIGARSYQLGNGSPIDGNGHGTHTASTAAGAFVKGANVYGNANGTAVGVAPLAHIAIYKVCGSDGKCSDSDILAAMDSAIDDGVDIISMSLGGGPVPFHSDNIALGAYSATERGILVSASAGNSGPSLITAGNTAPWILTVGASTTDRKIKVTVTLGNTEEFEGEASYRPQISDSKFFTLYDASKGKGDPSKTPYCKPGSLTDPAIKGKIVICYPGVVSKVVKGQAVKDAGGVGMIAINLPEDGVTKSADAHVLPALEVSAADGIRILTYTNSISNPTAKITFQGTIIGDENAPIVASFSSRGPNKPSPGILKPDIIGPGVNILAAWPTSVDDNKKTKSTFNIISGTSMSCPHLSGVAALLKSTHPDWSPAAIKSAIMTTAYTLNLASSPILDERLLPADIFAIGAGHVNPSSANDPGLVYDTPSEDYFPYLCGLRYTNAQVSKLLQRKVNCLEVKSIPEAELNYPSFSIFGLGSTPQTYTRTVTNVGDVASSYKVEIASPIGVAIEVVPTELNFSKLNQKLTYQVTFSKTTSSSEVVVVEGFLKWTSTRHSVRSPIAVVLV

SEQ ID NO: 45 - protein, 747 aa, Solanum esculentum
MGFLKILLIFIFCSFLRPSIQSDLETYIVHVESPENQISTQSSLTDLESYYLSFLPKTTTAISSSGDEEAASMIYSYHNVMKGFAARLTAAQVKEMEKKHGFVSAQKQRIFSLHTTHTPSFLGLQQNMGLWKDSNFGVGVIIGVLDTGILPDHPSFSDVGMPPPPAKWKGVCESNFTTKCNNKLIGARSYQLGNGSPIDDNGHGTHTAGTAAGAFVKGVNIFGNANGTAVGVAPLAHIAVYKVCSSDGGCSDSDILAAMDAAIDDGVDILSISLGGSTKPFHDDGIALGTYSATERGIFVSASAGNSGPSLGTVANEAPWILTVGASTHDRKLKVTVKLGNSEEFEGESAYHPKTSNSTFFPLYDAGKNESDQFSAPFCSPGSLNDPAIKGKIVLCLRSISLLRVAQGQSVKDAGGVGMILINEQKRGVTKSAEAHVLPALDVSNADGKKILAYMNSSSNPVASITFHGTVIGDKNAPIVASFSSRGPSVASPGILKPDIIGPGVNVLAAWPTSVDNNKNTKSTFNIVSGTSMSCPHLSGVAALLKSAHPDWSPAAIKSAMMTTADTVNLANSPILDERLISADLFAMGAGHVNPSRASDPGLVYDTPFEDYIPYLCGLNYTNREVGKVLQRKVNCSEVKRIPEGQLNYPSFSIRLGSTPQTYTRTVTNVGDAKSSYKVEIVSPKGVVVKVEPSALNFSTLNQKLTYQVIFTKTTNISTTSDVEGFLKWNSNRHSVRSPIAVRVSAE

SEQ ID NO: 46 - protein, 754 aa, Solanum esculentum
MGFLKIFFVFIFCSFPWPTIQSDFETYIVHVESPESLITTQSSFMDLESYYLSFLPETMSAISSSGNEEAASIIYSYHNVMTGFAARLTAEQVKEMEKKHGFVSAQKQRILSLHTTHTPSFLGLQQNKGVWKDSNYGKGVIIGVLDTGIIPDHPSFSDVGMPSPPAKWKGVCKSNFTNKCNNKLIGARSYELGNASPIDNDGHGTHTASTAAGAFVKGANVHGNANGTAVGVAPLAHIAIYKVCGFDGKCPGSDILAAMDAAIDDGVDILSISLGGSLSPLYDETIALGAYSTTQRGILVSCSAGNSGPSPASVDNSAPWILTVGASTLDRKIKATVKLGNGEEFEGESAYHPKTSNATFFTLFDAAKNAKDPSETPYCRRGSLTDPAIRGKIVLCLAFGGVANVDKGQAVKDAGGVGMIVINPSQYGVTKSADAHVLPALVVSAADGTKIRAYTNSILNPVATITFQGTIIGDKNAPIVAAFSSRGPNTASRGILKPDIIGPGVNILAAWPTSVDGNKNTKSTFNIISGTSMSCPHLSGVAALLKSSHPDWSPAVIKSAIMTTADTLNLASSPILDERLSPADIYAIGAGHVNPSRANDPGLVYDTPFEDYLPYLCGLNYTNSQVGKLLKRKVNCSEVESIPEAQLNYPSFCISRLGSTPQTFTRTVTNVGDAKSSYTVQIASPKGVVVKVKPRKLIFSELKQKLTYQVTFSKRTNSSKSGVFEGFLKWNSNKYSVRSPIAVEFALATKYSDI

SEQ ID NO: 47 - protein, 747 aa, Solanum esculentum
MGFLKILLIFIFCSFLRPSIQSDLETYIVHVESPENQISTQSSLTDLESYYLSFLPKTTTAISSSGDEEAASMIYSYHNVMKGFAARLTAAQVKEMEKKHGFVSAQKQRIFSLHTTHTPSFLGLQQNMGLWKDSNFGVGVIIGVLDTGILPDHPSFSDVGMPPPPAKWKGVCESNFTTKCNNKLIGARSYQLGNGSPIDDNGHGTHTAGTAAGAFVKGANIFGNANGTAVGVAPLAHIAVYKVCSSDGGCSDSDILAAMDAAIDDGVDILSISLGGSTKPFHDDGIALGTYSATERGIFVSASAGNSGPSLGTVANEAPWILTVGASTHDRKLKVTVKLGNSEEFEGESAYHPKTSNSTFFPLYDAGKNESDQFSAPFCSPGSLNDPAIKGKIVLCLRSISLLRVAQGQSVKDAGGVGMILINEQEEGVTKSAEAHVLPALDVSNADGKKILAYMNSSSNPVASITFHGTVIGDKNAPIVASFSSRGPSVASPGILKPDIIGPGVNVLAAWPTSVDNNKNTKSTFNIVSGTSMSCPHLSGVAALLKSAHPDWSPAAIKSAMMTTADTVNLANSPILDERLISADLFAMGAGHVNPSRASDPGLVYDTPFEDYIPYLCGLNYTNREVGKVLQRKVNCSEVKRIPEGQLNYPSFSIRLGSTPQTYTRTVTNVGDAKSSYKVEIVSPKGVVVKVEPSALNFSTLNQKLTYQVIFTKTTNISTTSDVEGFLKWNSNRHSVRSPIAVRVSAE

SEQ ID NO: 48 - protein, 747 aa, Solanum esculentum
MGFLKILLVFIFGSFPWPTIQSNLETYLVHVESPESLISTQSSLTDLDSYYLSFLPKTTTAISSSGNEEAATMIYSYHNVMTGFAARLTAEQVKEMEKIHGFVSAQKQRTLSLDTTHTSSFLGLQQNMGVWKDSNYGKGVIIGVIDTGILPDHPSFSDVGMPPPPAKWKGVCESNFTNKCNNKLIGARSYQLGHGSPIDDDGHGTHTASTAAGAFVNGANVFGNANGTAAGVAPFAHIAVYKVCNSDGCADTDVLAAMDAAIDDGVDILSISLGGGGSSDFYSNPIALGAYSATERGILVSCSAGNNGPSTGSVGNEAPWILTVGASTQDRKLKATVKLGNGEEFEGESAYRPKISNSTFFALFDAGKNASDEFETPYCRSGSLTDPVIRGKIVICLAGGGVPRVDKGQAVKDAGGVGMIIINQQRSGVTKSADAHVLPALDISDADGTKILAYMNSTSNPVATITFQGTIIGDKNAPIVAAFSSRGPSGASIGILKPDIIGPGVNILAAWPTSVDDNKNTKSTFNIISGTSMSCPHLSGVAALLKSTHPDWSPAAIKSAMMTTADTLNLANSPILDERLLPADIYAIGAGHVNPSRANDPGLVYDTPFEDYVPYLCGLNYTNRQVGNLLQRKVNCSEVKSILEAQLNYPSFSIYDLGSTPQTYTRTVTNVGDAKSSYKVEVASPEGVAIEVEPSELNFSELNQKLTYQVTFSKTANSSNTEVIEGFLKWTSNRHSVRSPIALLLIQ

SEQ ID NO: 49 - protein, 754 aa, Solanum esculentum
MGFLKILLVLIFCSFPWPTIQSGLEIYIVHVESPESLISTQSSFTDLDSYYLSFLPETTSAISSSGNEEAATMIYSYHNVMTGFAARLTASHVKEMEKKRGFVSAQKQRILSLDTTHTPSFLGLQQNMGVWKDSNYGKGVIIGVLDTGILPDHPSFSDVGMPPPPAKWKGVCESNFTNKCNNKLIGARSYHLGNGSPIDGDGHGTHTASTAAGAFVKGANVYGNANGTAVGVAPLAHIAVYKVCSSDGGCSDSDILAAMDSAIDDGVDILSISIGGSPNSLYDDPIALGAYSATARGVFVSCSAGNRGPLLASVGNAAPWILTVGASTLDRKIKATVKLGNGEEFEGESAYRPQTSNSTFFTLFDAAKHAKDPSETPYCRPGSLTDPVIRGKIVLCLACGGVSSVDKGKVVKDAGGVGMIVINPSQYGVTKSADAHVLPALDVSDADGTRIRAYTNSILNPVATITFQGTIIGDENAPIVAAFSSRGPNTASPGILKPDIIGPGVNILAAWPTSVDGNKNTKSTFNIISGTSMSCPHLSGVAALLKSSHPDWSPAVIKSAIMTTADTLNLASSPILDERLSPADIYAIGAGHVNPSRANDPGLVYDTPFEDYLPYLCGLNYTNSQVGKLLKRKVNCSEVESIPEAQLNYPSFCISRLGSTPQTFTRTVTNVGDAKSSYTVQIASPKGVVVKVKPRKLIFSELKQKLTYQVTFSKRTNSSKSGVFEGFLKWNSNKYSVRSPIAVEFALATKYSDI

SEQ ID NO: 50 - protein, 745 aa, Solanum esculentum
MGFLKILLVFIFCSFPWPTIQSNLETYLVHVESPESLISTQSSLTDLDSYYLSFLPKTTTAISSSGNEEAATMIYSYHNVMTGFAARLTAEQVKEMEKIHGFVSAQKQRTLSLDTTHTSSFLGLQQNMGVWKDSNYGKGVIIGVIDTGILPDHPSFSDVGMPPPPAKWKGVCESNFTNKCNNKLIGARSYQLGHGSPIDDDGHGTHTASTAAGAFVNGANVFGNANGTAAGVAPFAHIAVYKVCNSDGCADTDVLAAMDAAIDDGVDILSISLGGGGSSDFYSNPIALGAYSATERGILVSCSAGNNGPSTGSVGNEAPWILTVGASTQDRKLKATVKLGNREEFEGESAYRPKISNSTFFALFDAGKNASDEFETPYCRSGSLTDPVIRGKIVICLAGGGVPRVDKGQAVKDAGGVGMIIINQQRSGVTKSADAHVIPALDISDADGTKILAYMNSTSNPVATITFQGTIIGDKNAPIVAAFSSRGPSGASIGILKPDIIGPGVNILAAWPTSVDDNKNTKSTFNIISGTSMSCPHLSGVRALLKSTHPDWSPAAIKSAMMTTADTLNLANSPILDERLLPADIYAIGAGHVNPSRANDPGLVYDTPFEDYVPYLCGLNYTNRQVGNLLQRKVNCSEVKSILEAQLNYPSFSIYDLGSTPQTYTRTVTNVGDAKSSYKVEVASPEALPSKLTLRANFSSDQKLTYQVTFSKTANSSNTEVIEGFLKWTSNRHSVRSPIALLLIQ

SEQ ID NO: 51 - protein, 777 aa, Solanum esculentum
MESRMEFRYFLHLLFLSTHMFCFLTIAQRSTYIVHLDKSLMPNVFTDHHHWHSSTIDSIKASVPSSVDRFHSAPKLVYSYDNVFHGFSAVLSQNELAALKKLPGFVSAYEDRTVEPHTTHTSDFLKLNPSSGLWPASGLGQDVIIAVLDGGIWPESASFQDDGMPEIPKRWKGICRPGTQFNTSMCNRKLIGANYFNKGILADDPTVNISMNSARDTNGHGTHCASIAAGNFAKDASHFGYAPGIARGVAPRARIAVYKFSFSEGTFTSDLIAAMDQAVADGVDMISISFGYRFIPLYEDAISIASFGAMMKGVLVSASAGNRGPSVGSLGNGSPWILCVAAGHTDRRFAGTLTLGNGLKIRGWSLFPARAYVRDSLVIYNKTLATCDSVELLSQVPDAERTIVICDYNADEDGFGFASQIFNINQARVKAGIFISEDPTVFTSSSFSYPGVVINKKEGKQVINYVKNSASPTATITFQETYMDGERPAPILARFSARGPSRSYLGIPKPDIMAPGVLILAAFPPNIFSESIQNIELSSDYELKSGTSMAAPHAAGIAAMLKGAHPEWSPSAIRSAMMTTANHLDSTQKPIREDDNMIATPLDMGAGHVDPNRALDPGLVYDATPQDYINLICSMNFTEEQFKTFARSSANYNNCSNPSADLNYPSFIALYPFSLEGNFTWLEQKFRRTLTNVGKGGATYKVKIETPKNSTVSVSPRTLVFKGKNDKQSYNLTIRYIGDSDQSKNFGSITWVEENGNHTVRSPIVTSTIIEVWGSED

SEQ ID NO: 52 - protein, 666 aa, Solanum esculentum
MGFFKILFVFIFCSFPWPTIQSDLETYIVHVESPESLITTQSSLTDLDSYYLSFLPKTTTTISSSGNEEAATMIYSYHNVMTGFAARLTAEQVKEMEKKHGFVSAQKQRILSLHTTHTPSFLGLQQNMGLWKDSNYGKGVIIGVIDTGIVPDHPSLSDVGMPSPPAKWKGVCESNFTNKCNNKLIGARSYQLANGSPIDDDGHGTHTASTAAGAFVNGANVFGNANGTAVGVAPLAHIAIYKVCSSDGCSDSDILAAMDAAIDDGVDILSISLGGSPIPLYEDSIAMGAYSATERGILVSCSAGNDGHSMGSVDNSAPWILTVGASTLDRKIKATVKLGNREEFQGESAYRPQISNSTFFTLFDAAKNASDEFKTPYCRPGSLTDPAIRGKIVLCLAFGGVTIVDKGQAVKDAGGVGMIIINSPDDGVTKSADAHVLPALDVSDADGTKILAYMNSTSNPVATIAFQGTIIGDKNAPMVAAFSSRGPSRASPGILKPDIIGPGVNILAAWPTSVDDNKDTKSTFNIISGTSMSCPHLSGVAALLKSTHPDWSPAAIKSAIMTTADTLNLANSPILDERLLPADIFATGAGHVNPSRANDPGLVYDIPFEDYLPYLCGLNYTNRQVGNLLQRRVNCSEVKIILEAQLNYPSFCITELGSRLFERTLI

SEQ ID NO: 53 - protein, 770 aa, Glycine max
MKGNNTLLLHLFYTLLLFLGVSAGNGNNDDTNRKEVYIVYMGAADSTNVSLRNDHAQVLNLVLRRNENALVRNYKHGFSGFAARLSKEEAASIAHKPGVVSVFPDPILNLHTTRSWEFLKYQTHVKIDTKPNAVSNSSSSSDIILGVLDTGIWPEAASFSDEGMGPVPSRWKGTCMKSQDFNSSNCNRKLIGARFYTDPTGNDDDEGDNTPRDSVGHGTHVASTAVGATVTNASYYGLAAGSATGGSSESRLAVYRVCSNFGCRGSAILGAFDDAISDGVDVLSLSLGASPGFQPDLTTDPIALGAFHAVERGILVVCSAGNSGPSSSTVVNDAPWILTVAASTIDRDFQSDVVLGVDKTVKGRAINFSPLSNSAEYPMIYGESAKAASTSLAEARQCHPDSLDANKVKGKIVVCDGKNDGYSTSEKIGTVKEAGGIGLVHITDQNGAIASYYGDFPATVISSKDGVTILQYINSTSNPVATILPTATVLDYKPAPVVPNFSSRGPSSLSSNILKPDIAAPGVNILAAWIGNNADDVPKGRKPSLYNIISGTSMACPHVSGLASSVKTRNPTWSASAIKSAIMTSAIQINNLKAPITTDSGRVATPYDYGAGEMTTSESLQPGLVYETNTIDYLNYLCYIGLNITTVKVISRTVPANFSCPKDSSSDLISNINYPSIAVNFTGKAAVNVSRTVTNVGEEDETAYSPVVEAPSGVKVTVTPDKLQFTKSSKKLGYQVIFSSTLTSLKEDLFGSITWSNGKYMVRSPFVLTK

SEQ ID NO: 54 - protein, 766 aa, Glycine max
MKGNDTLLLHLFYTLLLFLGVRSSSSAGNGSNDVTNRKEVYIVYMGAADSTDASFRNDHAQVLNSVLRRNENALVRNYKHGFSGFAARLSKKEATSIAQKPGVVSVFPGPVLKLHTTRSWDFLKYQTQVKIDTKPNAVSKSSSVIGILDTGIWPEAASFSDKGMGPVPSRWKGTCMKSQDFYSSNCNRKLIGARYYADPNDSGDNTARDSNGHGTHVAGTAAGVMVTNASYYGVATGCAKGGSPESRLAVYRVCSNFGCRGSSILAAFDDAIADGVDLLSVSLGASTGFRPDLTSDPISLGAFHAMEHGILVVCSAGNDGPSSYTLVNDAPWILTVAASTIDRNFLSNIVLGDNKIIKGKAINLSPLSNSPKYPLIYGESAKANSTSLVEARQCRPNSLDGNKVKGKIVVCDDKNDKYSTRKKVATVKAVGGIGLVHITDQNEAIASNYGDFPATVISSKDGVTILQYINSTSNPVATILATTSVLDYKPAPLVPNFSSRGPSSLSSNILKPDIAAPGVNILAAWIGNGTEVVPKGKKPSLYKIISGTSMACPHVSGLASSVKTRNPAWSASSIKSAIMTSAIQSNNLKAPITTESGSVATPYDYGAGEMTTSEPLQPGLVYETSSVDYLNFLCYIGFNVTTVKVISKTVPRNFNCPKDLSSDHISNINYPSIAINFSGKRAVNLSRTVTNVGEDDETVYSPIVDAPSGVHVTLTPNKLRFTKSSKKLSYRVIFSSTLTSLKEDLFGSITWSNGKYMVRSPFVLTK

SEQ ID NO: 55 - protein, 766 aa, Glycine max
MKGNDTLLLHLFYTLLLFLGVRSSSSAGNGSNDVTNRKEVYIVYMGAADSTDASFRNDHAQVLNSVLRRNENALVRNYKHGFSGFAARLSKKEATSIAQKPGVVSVFPGPVLKLHTTRSWDFLKYQTQVKIDTKPNAVSKSSSVIGILDTGIWPEAASFSDKGMGPVPSRWKGTCMKSQDFYSSNCNRKLIGARYYADPNDSGDNTARDSNGHGTHVAGTAAGVMVTNASYYGVATGCAKGGSPESRLAVYRVCSNFGCRGSSILAAFDDAIADGVDLLSVSLGASTGFRPDLTSDPISLGAFHAMEHGILVVCSAGNDGPSSYTLVNDAPWILTVAASTIDRNFLSNIVLGDNKIIKGKAINLSPLSNSPKYPLIYGESAKANSTSLVEARQCHPNSLDGNKVKGKIVVCDDKNDKYSTRKKVATVKAVGGIGLVHITDQNEAIASNYGDFPATVISSKDGVTILQYINSTSNPVATILATTSVLDYKPAPLVPNFSSRGPSSLSSNILKPDIAAPGVNILAVWIGNGTEVVPKGKKPSLYKIISGTSMACPHVSGLASSVKTRNPTRSASSIKSAIMTSAIQSNNLKAPITTESGSVATPYDYGAGEMTTSEPLQPGLVYETSSVDYLNFLCYIGFNVTTVKVISKTVPRNFNCPKDLSSDHISSINYPSIAINFSGKRAVNLSRTVTNVGEDDETVYSPIVDAPSGVHVTLTPNKLRFTKSSKKLSYRVIFSSTLTSLKEDLFGSITWSNGKYMVRSPFVLTK

SEQ ID NO: 56 - protein, 769 aa, Glycine max
MKGNNTLLLPLFYTLLLFLGVSAGNGSNDDTNRKEVYIVYMGAADSTNAYLRNDHVQILNSVLKRNENAIVRNYKHGFSGFAARLSKEEANSISQKPGVVSVFPDPILKLHTTRSWDFLKSQTRVNIDTKPNTESSSSSSSDVILGILDTGIWPEAASFSDEGFGPVPSRWKGTCMTSKDFNSSNCNRKLIGARFYPDPDGKNDDNDKTPRDSNGHGTHVASTAVCVAVSNASFYGLATGTAKGGSPESRLAVYKVCYRNGCRGSAILAAFDDAIADGVDVLSLSLGVLPLSRPKLTSDTIAIGAFHAVQRGILVVCAAGNAGPLKYSVVNDAPWILTVAASTIDRDLQSNVVLGTNHVVKGRAINFSPLSNSPEYPMVYGESAKAKRANLGTARKCHPNSLDRNKVKGKIVICDGKKDPKYITMEKINIVKAAGGIGLAHITDQDGSVAFNYVDFPATEISSKDGVALLQYINSTSNPVGTILATVTVPDYKPAPVVGFFSSRGPSTLSSNILKPDIAAPGVNILAAWIGDDTSEVPKGRKPSLYNIISGTSMATPHVSGLVCSVKTQNPSWSASAIKSAIMTSAIQNDNLKAPITTDSGSIATPYDYGAGEITTSKPLQPGLVYETNTVDYLNYLCYTGHNLTTVKVISGTVPDNFNCPKDSTSDLISNINYPSIAVNFTGKANVVVSRTVTNVAEEDETVYSAVVEAPKGVFVKVTPNKLQFTKSSKKLSYQVIFAPKASLRKDLFGSITWSNGKYIVRSPFVLTK

SEQ ID NO: 57 - protein, 770 aa, Glycine max
MKGNNTLLLHLFYTTLFLFLVVSSSSSTGNESNDDTNSKEVYIVYMGAADSTKASLKNEHAQILNSVLRRNENALVRNYKHGFSGFAARLSKEEANSIAQKPGVVSVFPDPILKLHTTRSWDFLKSQTRVNIDTKPNTLSGSSFSSSDVILGVLDTGIWPEAASFSDKGFGPVPSRWKGTCMTSKDFNSSCCNRKIIGARFYPNPEEKTARDFNGHGTHVSSTAVGVPVSGASFYGLAAGTARGGSPESRLAVYKVCGAFGSCPGSAILAGFDDAIHDGVDILSLSLGGFGGTKTDLTTDPIAIGAFHSVQRGILVVCAAGNDGEPFTVLNDAPWILTVAASTIDRDLQSDVVLGNNQVVKGRAINFSPLLNSPDYPMIYAESAARANISNITDARQCHPDSLDPKKVIGKIVVCDGKNDIYYSTDEKIVIVKALGGIGLVHITDQSGSVAFYYVDFPVTEVKSKHGDAILQYINSTSHPVGTILATVTIPDYKPAPRVGYFSSRGPSLITSNVLKPDIAAPGVNILAAWFGNDTSEVPKGRKPSLYRILSGTSMATPHVSGLACSVKRKNPTWSASAIKSAIMTSAIQNDNLKGPITTDSGLIATPYDYGAGAITTSEPLQPGLVYETNNVDYLNYLCYNGLNITMIKVISGTVPENFNCPKDSSSDLISSINYPSIAVNFTGKADAVVSRTVTNVDEEDETVYFPVVEAPSEVIVTLFPYNLEFTTSIKKQSYNITFRPKTSLKKDLFGSITWSNDKYMVRIPFVLTK

SEQ ID NO: 58 - protein, 778 aa, Glycine max
MEGLQKFLHFFFVASLLISTTAISDHTPKPYVVYMGNSSPNKIGVESQIAESSHLQLLSLIIPSEESERIALTHHFSHAFSGFSAMLTESEASALSGHDGVVSVFPDPVLELHTTRSWDFLESELGMKPYYSHGTPTLHKHPSTDIIIGVIDTGIWPESPSFRDEGIGEIPSKWKGVCMEGRDFKKSNCNRKLIGARYYKIQATSGDNQTHIEAAKGSPRDTVGHGTHTASIAAGVHVNNASYFGLAKGTARGGSPSTRIAAYKTCSDEGCSGATILKAIDDAVKDGVDIISISIGLSSLFQSDFLSDPIAIGAFHAEQKGVLVVCSAGNDGPDPFTVVNSAPWIFTIAASNIDRNFQSTIVLGNGKYLQGTGINFSNLTHSKMHRLVFGEQVAAKFVPASEARNCFPGSLDFNKTAGNIVVCVNDDPSVSRRIKKLVVQDARAVGIILINENNKDAPFDAGVFPFTQVGNLEGHQILKYINSTKNPTATILPTTEVARSKPSPIVASFSSRGPSSLTENILKPDVMAPGVGILAAVIPKSKEPGSVPIGKKPSLYAIKSGTSMACPHVTGAAAFIKSVHKKWSSSMIKSALMTTATNYNNMRKPLTNSSNSIAGPHEMGVGEINPLRALNPGLVFETDVEDYLRFLCYFGYSQKIIRSISETNFNCPKNSSEDLISSVNYPSISISTLKRQQKAKVITRTVTNVGYLNATYTAKVRAPQGLVVEVIPNKLVFSEGVQRMTYKVSFYGKEAHGGYNFGSLTWLDGHHYVHTVFAVKVE

SEQ ID NO: 59 - protein, 777 aa, Glycine max
MECLQQFLHFLFVASLLISSTAISDQIPKPYVVYMGNSSPNNIGVEGQILESSHLHLLSSIIPSEQSERIALTHHFSHAFSGFSALLTEGEASALSGHDSVVSVFPDPVLQLHTTRSWDFLESDLGMKPYSYGTPKLHQHSSSDIIIGVIDTGIWPESPSFRDEGIGEIPSRWKGVCMEGSDFKKSNCNRKLIGARYYNILATSGDNQTHIEATKGSPRDSVGHGTHTASIAAGVHVNNASYFGLAQGTARGGSPSTRIAAYKTCSDEGCSGATILKAIDDAVKDGVDIISISIGLSSLFQSDFLSDPIAIGAFHAEQKGVLVVCSAGNDGPDPFTVVNTAPWIFTIAASNIDRNFQSTIVLGNGKYFQGTGINFSNLTHSKMHRLVFGEQVAAKFVPASEARNCFPGSLDFNKTAGSIVVCVNDDPTVSRQIKKLVVQDARAIGIILINEDNKDAPFDAGAFPFTQVGNLEGHQILQYINSTKNPTATILPTTEVSRLKPSPIVASFSSRGPSSLTENVLKPDVMAPGVGILAAVIPKTKEPGSVPIGKKPSLYAIKSGTSMACPHVTGAAAFIKSVHTKWSSSMIKSALMTTATNYNNLRKPLTNSSNSIADPHEMGVGEINPLRALNPGLVFETDVEDYLRFLCYFGYSQKIIRSMSKTNFNCPKNSSEGLISNVNYPSISVSTLKKQQKAKVITRKVTNVGSLNATYTAKVLAPEGLVVKVIPNKLVFSEGVQRMTYKVSFYGKEARSGYNFGSLTWLDGHHYVHTVFAVKVE

SEQ ID NO: 60 - protein, 782 aa, Glycine max
MALAWNLVITLILLLLQQSCFLVTFASSNVHIVYMGDRMSQSEQQLVEDSHLDILLRILGSKVAARRSILYSYKHGFSGFAAVLSQPQAKLIADFPGVVRVIPNKILSLHTTRSWDFLHVKQDIVTGALSRGQSGRGTIIGIMDTGIWPESESFRDEHMDNPPLHWRGICQEGESFDHSHCNSKIIGARWYIKGYEAEIGKLNTSDGVEYLSPRDASGHGTHTSSTAAGVAVENASFMGLAKGLARGGAPSAWLAIYKICWSTGGCSSADILAAFDDAIFDGVDILSASLGSDPPLPTYVEDALAIGSFHAVAKGISVVCSGGNSGPYPQTVINTAPWLVTVAASTIDREFSSRIILGNNQTLQGQSLYTGKDLSKFYPIVFGEDIAASDSDEESARSCNSGSLNSTLAKGKAILCFQSRSQRSATVAIRTVTEAGGAGLIFAQFPTKDVDTSWSKPCVQVDFITGTTILSYMEATRNPVIKFSKTKTVVGRQLSPEVAFFSSRGPSSLSPSVLKPDIAAPGVNILAAWSPASSARLVSDAENEDETELHPLNFNIESGTSMACPHITGIVALIKTIHPTWSPAAIKSALVTTASLKNEYKEYIWAEGAPHKQADPFDYGGGHVDPNKVTDPGLVYDMKNSDYIRFLCSMGYNNTAISILTGFPTKCHKSHKFLLNMNLPSITIPELKQPLTVSRTVTNVGPVKSNYTARVVAPIGISVIVEPSTLAFSSKRKKMKFKVTFSSKLRVQSRFSFGYLLWEDGLHEVRIPLAVRSAVHEFCGQI

SEQ ID NO: 61 - protein, 774 aa, Glycine max
MDTNSRNWRWARKAQLLIASALLLLQDSLVNSAEASSVHIVYMGDKIYQNPQTTKMYHHKMLSSLLGSKEAAKNSILYSYKHGFSGFAARLTKYQAEAIAKFPGVVSVIPNGIHKLHTTRSWDFMGVHHSTSKIAFSDSNLGEGTIIGVIDTGIWPESPSFNDEAMGQIPSRWKGICQGGKHFNSTNCNKKIIGARWFMKGISDQTKKLLQGNNSDEYLSARDAIGHGTHTASTAAGYFVGNANYRGLASGLARGGAPLAHLAIYKACWDFPIGDCTDADILKAFDKAIHDGVDVLTVSLGFAIPLFSYVDQRDSLAIGSFHATSKGITVVCSAGNSGPVSQTVTNTAPWIITVGATTIDRAFPAAITLGNNRTVWGQSIDMGKHNLGSVGLTYSERIAVDPSDNLAKDCQSGSLNATMAAGKIVLCFSVSDQQDIVSASLTVKEAGGVGLVYAQYHEDGLNQCGSFPCIKVDYEVGTQTLTYIRRSRFPTASLSFPKTVIGKWTSPRVASFSSRGPSSMSPTVLKPDIAAPGVDILAAFPPKGTTRSSGFAFLSGTSMSCPHVAGIAALIKSKHPTWSPAAIRSALVTTASQTGTDGSLISEEGSTHKAADPFDIGGGHVDPNKAMDPGLIYDITTEDYVQFLCSMGHSSASISKVTKTTTSCKKGKHQTLNLNLPSILVPNLKRVATVMRTVTNVGNITAVYKALLKVPYGIKVRVEPQTLSFNSDARILNFSVSFLSTQKFHGDYKFGSLTWTDGKYFVRTPIAVRTIQFE

SEQ ID NO: 62 - protein, 762 aa, Glycine max
MSSSGYATSSALFFLFLAVFAAKVSFCFSTKVYVVYMGSKSGEHPDDILKENHQILASVHSGSIEEAQASHIYTYKHGFRGFAAKLSDEQASQISKMPGVVSVFPNSKRKLHTTHSWDFMGLLDDQTMETLGYSIRNQENIIIGFIDTGIWPESPSFSDTDMPAVPPGWKGQCQSGEGFNASSCNRKVIGARYYRSGYEAAEGDSDAKKSFISARDSTGHGSHTASIAAGRFVANMNYKGLASGGARGGAPMARIAVYKTCWDSGCYDVDLLAAFDDAIRDGVHILSLSLGAESPQGDYFSDAISVGSFHAASRGVLVVASAGNEGSAGSATNLAPWMLTVAASSTDRDFTSDIILGNGAKIMGESLSLFEMNASTRIISASAANGGYFTPYQSSYCLESSLNKTKSKGKVLVCRHAESSTESKVLKSKIVKAAGGVGMILIDETDQDVAIPFVIPSAIVGNKIGEKILSYLRTTRKPVSRIFGAKTVLGAHPAPRVAAFSSKGPNALNPEILKPDVTAPGLNILAAWSPAAGNMFNILSGTSMACPHVTGIATLVKAVHPSWSPSAIKSAIMTTATVLDKHHRPITADPEQRRANAFDYGSGFVNPARVLDPGLIYDSKPADFVAFLCSLGYDQRSLHQVTRDNSTCDRAFSTASDLNYPSIAVPNLKDNFSVTRIVTNVGKARSVYKAVVSSPPGVRVSVIPNRLIFTRIGQKINFTVNFKLSAPSKGYAFGFLSWRNRISQVTSPLVVRVAPGKNGLVR

SEQ ID NO: 63 - protein, 762 aa, Glycine max
MSSSGYTTSSALFFLFLTVLAAKVSFCFSTKVYVVYMGSKSGEHPDDILKENHQILASVHSGSIEQAQASHIYTYRHGFRGFAAKLSDEQASQISKMPGVVSVFPNSKRKLHTTHSWDFMGLLDDQTMETLGYSIRNQENIIIGFIDTGIWPESPSFSDTDMPAVPPGWKGQCQSGEGFNSSSCNRKVIGARYYRSGYEAAEGDSDAKKSFRSARDSTGHGSHTASIAAGRFVANMNYKGLASGGARGGAPMARIAVYKTCWDSGCYDVDLLAAFDDAIRDGVHILSLSLGAESPQGDYFSDAISVGSFHAVSRGVLVVASAGNEGSAGSATNLAPWMLTVAASSTDRDFTSDIMLGNGAKIMGESLSLFEMNASTRIISASAANGGYFTPYQSSYCLESSLNKTKSKGKVLVCRHAESSTESKVEKSKIVKAAGGVGMILIDETDQDVAIPFVIPSAIVGKKTGEKILSYLRTTRKPESRIFGAKTVLGAHPAPRVAAFSSKGPNALNPEILKPDVTAPGLNILAAWSPAAGNMFNILSGTSMACPHVTGIATLVKAVHPSWSPSAIKSAILTTATILDKHHRPIIADPEQRRANAFDYGSGFVNPARVLDPGLIYDLKPADFVAFLCSLGYDPRSLHQVTRDNSTCDRAFSTASDLNYPSISVPNLKDNFSVTRIVTNVGKAKSVYKAVVSPPPGVRVSVIPNRLIFSRIGQKINFTVNFKVTAPSKGYAFGLLSWRNRRSQVTSPLVVRVAPGKNGLVR

SEQ ID NO: 64 - protein, 758 aa, Glycine max
MRFAKILSSFTLLFIGYTLVNGSTPKHYIVYMGDHSHPNSESVIRANHEILASVTGSLSEAKAAALHHYTKSFQGFSAMITPEQASQLAEYESVLSVFESKMNKLHTTHSWDFLGLETISKNNPKALDTTSDVIVGVIDSGIWPESESFTDYGLGPVPKKFKGECVTGEKFTLANCNKKIIGARFYSKGFEAEVGPLEGVNKIFFRSARDGDGHGTHTASTIAGSIVANASLLGIAKGTARGGAPSARLAIYKACWFDFCGDADILSAMDDAIHDGVDILSLSLGPDPPEPIYFENAISVGAFHAFQKGVLVSASAGNSVFPRTACNVAPWILTVAASTIDREFSSNILLGNSKVLKGSSLNPIRMDHSYGLIYGSAAAAVGVSATIAGFCKNNTLDPTLIKGKIVICTIEKFSDDRRAKAIAIRQGGGVGMILIDHNAKDIGFQFVIPSTLIGQDAVEELQAYIKTDKNPTARIYPTITVVGTKPAPEMAAFSSIGPNIITPDIIKPDITAPGVNILAAWSPVATEATVEQRSIDYNIISGTSMSCPHITAVAAIIKSHHPHWGPAAIMSSIMTTATVMDNTRRIIGRDPNGTQTTPFDYGSGHVNPVASLNPGLVYEFNSKDVLNFLCSNGASPAQLKNLTGALTQCQKPLTASSNFNYPSIGVSNLNGSSSVYRTVTYYGQGPTVYHASVENPSGVNVKVTPAELKFRKTGEKITFRIDFFPFKNSNGNFVFGALIWNNGIQRVRSPIGLNVVST

SEQ ID NO: 65 - protein, 758 aa, Glycine max
MGFAKILSSFTVLFIGYTLVNGSTPKHYIVYMGDHSHPNSESVIRANHEILASVTGSLSEAKAAALHHYSKSFQGFSAMITPVQASQLAEYKSVVSVFESKMNKLHTTHSWDFLGLETINKNNPKALDTTSDVIVGVIDSGIWPESESFTDYGLGPVPKKFKGECVTGEKFTLANCNKKIIGARFYSKGIEAEVGPLETANKIFFRSARDGDGHGTHTASTIAGSIVANASLLGIAKGTARGGAPSARLAIYKACWFDFCSDADVLSAMDDAIHDGVDILSLSLGPDPPQPIYFENAISVGAFHAFQKGVLVSASAGNSVFPRTACNVAPWILTVAASTIDREFSSNIYLGNSKVLKGSSLNPIRMEHSNGLIYGSAAAAAGVSATNASFCKNNTLDPTLIKGKIVICTIETFSDDRRAKAIAIRQGGGVGMILIDHNAKDIGFQFVIPSTLIGQDAVQELQAYIKTDKNPTAIINPTITVVGTKPAPEMAAFSSIGPNIITPDIIKPDITAPGVNILAAWSPVATEATVEHRSVDYNIISGTSMSCPHVTAVAAIIKSHHPHWGPAAIMSSIMTTATVIDNTRRVIGRDPNGTQTTPFDYGSGHVNPVASLNPGLVYDFNSQDVLNFLCSNGASPAQLKNLTGVISQCQKPLTASSNFNYPSIGVSSLNGSLSVYRTVTYYGQGPTVYRASVENPSGVNVKVTPAELKFVKTGEKITFRIDFFPFKNSDGSFVFGALIWNNGIQRVRSPIGLNVLST

SEQ ID NO: 66 - protein, 762 aa, Glycine max
MSCSNYARSCTFFYLFLAVLLAKTSSCFSAKVYVVYMGSKTGEDPDDILKHNHQMLASVHSGSIEQAQASHVYSYKHAFRGFAAKLTNEQAYQISKMPGVVSVFPNAKRKLHTTHSWDFIGLLGNESMEIHGHSTKNQENIIIGFIDTGIWPESSSFSDTDMPPVPRGWKGHCQLGEAFNASSCNRKVIGARYYISGHEAEEESDREVSFISARDSSGHGSHTASTAAGRYVANMNYKGLAAGGARGGAPKARIAVYKVCWDSGCYDVDLLAAFDDAIRDGVHIISLSLGPESPQGDYFSDAVSVASFHAAKHRVLVVASVGNQGNPGSATNVAPWIITVAASSIDRNFTSDITLGNGVNITGESLSLLGMDASRRLIDASEAFSGYFTPYQSSYCVDSSLNKTKAKGKVLVCRHAEYSGESKLEKSKIVKKAGGVGMILIDEANQGVSTPFVIPSAVVGTKTGERILSYINSTRMPMSRISKAKTVLGVQPAPRVAAFSSKGPNALTPEILKPDVTAPGLNILAAWSPASAGMKFNIISGTSMSCPHITGIATLVKAVHPSWSPSAIKSAIMTTATILDKHHQPIRADPDRRRANAFDYGSGFVNPSRVLDPGLVYDSHPEDFVAFLCSLGYDERSLHLVTGDNSTCDRAFKTPSDLNYPSIAVPNLEDNFSVTRVVTNVGKARSIYKAVVVSPAGVNVTVVPNRLVFTRIGEKIKFTVNFKVVAPSKDYAFGFLSWKNGRTQVTSPLVIKVAPASHGLVR

SEQ ID NO: 67 - protein, 763 aa, Glycine max
MSCSNYARSTSTFFYLFLAVLVANTSFCFSAKVYVVYMGSKTGENPDDILKHNHQMLAAVHSGSIEQAQASHVYSYKHAFRGFAAKLTNEQAYQISKMPGVVSVFPNSKRKLHTTHSWDFIGLLDNESMEIHGHSTKNQENIIIGFIDTGIWPESPSFSDTDMPPVPRGWKGHCQLGEAFNASSCNRKVIGARYYMSGHEAEEGSDRKVSFRSARDSSGHGSHTASTAVGRYVANMNYKGLGAGGARGGAPKARIAVYKVCWDSGCYDVDLLAAFDDAIRDGVHIMSLSLGPESPQGDYFDDAVSVASFHAAKHGVLVVASVGNQGNPGSATNVAPWIITVAASSTDRDFTSDITLGNGVNITGESLSLLGMSASRRLIDASEAFTGYFTPYQSSYCVDSSLDKTKAKGKVLVCRHTEYSGESKLEKSKIVKEAGGVGMILIDEANQGVSTPFVIPSAVVGTKTGERILSYINRTRMPMTRISRAKTVLGVQPAPCVAAFSSKGPNTLTPEILKPDVTAPGLNILAAWSPASAGMKFNIVSGTSMSCPHVTGIATLVKAVHPSWSPSAIKSAIMTTATILDKHHQPIRADPDRRRANAFDYGSGFVNPSRVLDPGLVYDSNPEDFVAFLCSLGYDERSLHLVTKDNSTCDRAFKTPSDLNYPSIAVPNLEDNFSVTRVVTNVGKARSIYKAVVVSPTGVNVTVVPNRLVFTRIGQKIKFTVNFKVAAPSKGYAFGFLSWKNGRTQVTSPLVVKVAPASHGLVR

SEQ ID NO: 68 - protein, 773 aa, Glycine max
MGKQVLNSFRPPVVFLLFFIVFSVVSCDEASKTFIFRVDSQSKPTIFPTHYHWYTSEFAQETSILHVYDTVFHGFSAVLTHQQVASISQHPSVLAVFEDRRRQLHTTRSPQFLGLRNQRGLWSESDYGSDVIIGVFDTGVWPERRSFSDLNLGPIPRRWKGACETGVRFSPKNCNRKLIGARFFSKGHEAGAGSGPLNPINDTVEFRSPRDADGHGTHTASTAAGRYAFQASMSGYAAGIAKGVAPKARLAAYKVCWKNSGCFDSDILAAFDAAVNDGVDVISISIGGGDGIASPYYLDPIAIGSYGAVSRGVFVSSSAGNDGPSGMSVTNLAPWLTTVGAGTIDRDFPSQVILGDGRRLSGVSLYAGAALKGKMYQLVYPGKSGILGDSLCMENSLDPNMVKGKIVICDRGSSPRVAKGLVVKKAGGVGMILANGISNGEGLVGDAHLLPACAVGANEGDVIKKYISSSTNPTATLDFKGTILGIKPAPVIASFSARGPNGLNPQILKPDFIAPGVNILAAWTQAVGPTGLDSDTRRTEFNILSGTSMACPHVSGAAALLKSAHPDWSPAALRSAMMTTATVLDNRNQIMTDEATGNSSTPYDFGAGHLNLGRAMDPGLVYDITNNDYVNFLCGIGYGPKVIQVITRAPASCPVRRPAPENLNYPSFVAMFPASSKGVASKTFIRTVTNVGPANSVYRVSVEAPASGVSVTVKPSRLVFSEAVKKRSYVVTVAGDTRKLKMGPSGAVFGSLTWTDGKHVVRSPIVVTQIEPL

SEQ ID NO: 69 - protein, 770 aa, Glycine max
MGKQVLNSFPLIVFFFILFSTVSADEVSKTFIFRVDSQSKPTVFPTHYHWYTSEFAQETSILHLYDTVFCGFSAVLTSHQVASISQHPSVLAVFEDRRRQLHTTRSPQFLGLRNQRGLWSESDYGSDVIVGVFDTGVWPERRSFSDLNLGPIPRRWKGACETGASFSPKNCNRKLIGARFFSKGHEAGAGSGPLNPINETVEFRSPRDADGHGTHTASTAAGRYAFQASMSGYAAGIAKGVAPKARLAVYKVCWKNSGCFDSDILAAFDAAVNDGVDVISISIGGGDGIASPYYLDPIAIGSYGAVSRGVFVSSSAGNDGPSGMSVTNLAPWLTTVGAGTIDREFPSQVILGDGRRLSGVSLYAGAALKGKMYQLVYPGKSGILGDSLCMENSLDPSMVKGKIVICDRGSSPRVAKGLVVKKAGGVGMILANGISNGEGLVGDAHLLPACAVGANEGDLIKKYISSSKNPTATLDFKGTILGIKPAPVIASFSARGPNGLNPEILKPDLIAPGVNILAAWTEAVGPTGLDSDTRRTEFNILSGTSMACPHVSGAAALLKSAHPDWSPAAIRSAMMTTATVLDNRNKTMTDEATGNSSTPYDFGAGHLNLGRAMDPGLVYDITNNDYVNFLCGIGYGPKVIQVITRAPASCPVRRPAPENLNYPSFVALFPVSSKRVASKTFIRTVSNVGPANSVYRVSVEAPASGVTVKVKPSRLVFSEAVKKRSYAVTVAGDTRNLKMGQSGAVFGSLTWTDGKHVVRSPIVVSQIEPL

SEQ ID NO: 70 - protein, 770 aa, Glycine max
MVDKMNMLIFKSLQISLLLVFSIRNTTAEKKTHHTKHTYIIHMDKFNMPESFNDHLLWFDSSLKSVSDSAEMLYTYKKVAHGFSTRLTTQEAELLSKQPGVLSVIPEVRYDLHTTRTPEFLGLAKYSTLSLASGKQSDVIVGVLDTGVWPELKSFDDTGLGPVPSSWKGECERGKNFNPSNCNKKLVGARFFSRGYEAAFGPIDEKTESKSPRDDDGHGSHTSTTAAGSAVVGASLFGFANGTARGMATQARLATYKVCWLGGCFTSDIAAGIDKAIEDGVNILSMSIGGGLMDYYKDTIAIGTFAATAHGILVSNSAGNGGPSQATLSNVAPWLTTVGAGTIDRDFPAYITLGNGKMYTGVSLYNGKLPPNSPLPIVYAANVSDESQNLCTRGTLIAEKVAGKIVICDRGGNARVEKGLVVKSAGGIGMILSNNEDYGEELVADSYLLPAAALGQKSSNELKKYVFSSPNPTAKLGFGGTQLGVQPSPVVAAFSSRGPNVLTPKILKPDLIAPGVNILAGWTGAVGPTGLTEDTRHVEFNIISGTSMSCPHVTGLAALLKGTHPEWSPAAIRSALMTTAYRTYKNGQTIKDVATGLPATPFDYGAGHVDPVAAFDPGLVYDTSVDDYLSFFCALNYSSYQIKLVARRDFTCSKRNNYRVEDLNYPSFAVPFNTAYGVKGGSRKPATVQYTRTLTNVGAPATYKVSVSQSPSVKIMVQPQTLSFGGLNEKKNYTVTFTSSSKPSGTNSFAYLEWSDGKHKVTSPIAFSWT

SEQ ID NO: 71 - protein, 767 aa, Glycine max
MEMFKKPFFATTFVLFMILCDVSLATKDNQKNTYIVHMAKSKMPASFNHHSVWYKSIMKSISNSTEMLYTYDNTIHGLSTRLTLEEARLLKSQTGILKVLPEKIYKPLTTRTPKFLGLDKIADMFPKSNEASDIVIGLLDTGVWPESKSFEDTGLGPIPSSWKGKCESGDNFTTLNCNKKLIGARFFLKGYEASMGPLNATNQFRSPRDADGHGTHTASTAAGSAVKGASLFGYASGTARGMASRARVAVYKVCWGDTCAVSDILAAMDAAISDNVNVISASLGGGAIDYDEENLAIGAFAAMEKGIVVSCAAGNTGPDSSSLQNIAPWMITVGAGTLDRDFPVNVNLGNGQNYSGVSIYDGKFSRHTLVPLIYAGNASAKIGAELCETDSLDPKKVKGKIVLCDRGNSSRVEKGLVVKSAGGVGMVLANSESDGEELVADAHLLPTTAVGFKAGKLIKLYLQDARKPTSRLMFEGTKVGIEPSPVVAAFSSRGPNPITPEVLKPDFIAPGVNILAAFTKLVGPTNLDQDDRRVDFNIISGTSMACPHASGIAALIKSFHPDWSPAAIRSALMTTAYTTYNNGKKLLDSATNGPSTPFEVGAGHVNPVAALNPGLVYDLAVDDYLNFLCALNYTPDRIEVVARRKFRCNAHKHYSVTDLNYPSFGVVFKPKVGGSGATIVKHKRTLTNVGDAGTYKVSVTVDISSVKIAVEPNVLSFNKNEKKSYTITFTVSGPPPPSNFGFGRLEWSNGKNVVGSPISITWESGRA

SEQ ID NO: 72 - protein, 777 aa, Glycine max
MANIMRNADPPALLSCNLLLLFFIILFSFLPQTIALQYQVSKTFIFRIDSESKPSVFPTHYHWYTSEFADPTRILHLYDTVFHGFSAVLTHQQVASLGQHPSVLAVFEDRRRHLHTTRSPQFVGLRNQRGLWSETDYGSDVIIGVFDTGIWPERRSFSDSNLGPIPKRWKGVCESGVRFSPSNCNRKLIGARFFSKGHEASGTSFNDTVEFRSPRDADGHGTHTASTAAGRYVFEASMAGYAFGVAKGVAPKARLAMYKLCWKNSGCFDSDILAAFDAAVADGVDVISMSIGGGDGISSPYYLDPIAIGSYGAVSRGVFVSSSGGNDGPSGMSVTNLAPWLTTVGAGTIDRDFPAEVILGNGRRLSGVSLYSGEPLKGKMYPLIYPGKSGVLTDSLCMENSLDPELVKGKIVVCDRGSSARVAKGLVVKKAGGVGMILANGISNGEGLVGDAHLLPACALGANFGDEIKEYINFSANPTATIDFKGTVVGIRPAPVVASFSARGPNGLSLEILKPDLTAPGVNILAAWTGGVGPSGLDSDTRRTEFNILSGTSMACPHVSGAAALLKSAHPDWSPAAIRSAMMTTATVFDNTNALMIDQATGNASTPYDFGAGHLNLALAMDPGLVYNITPHDYVTFLCAIGYGPRLIQVITGSPPNCPRRRPLPENLNYPSFVAVLPVSSSLLSKTFFRTVTNVGPPSAVYRVRVETQAEGVAVTVRPSQLVFSEAVKKRSFVVTVTADGRNLELGQAGAVFGSLSWTDGKHVVRSPMVVTQAQPL

SEQ ID NO: 73 - DNA, 1336 bp, Arabidopsis thaliana
cgaacggtcgtcataattccttgaaacctcgaaaatccaaaaacccatatccaatcttcttcccatataaattaagatttttatttatttatttgtttacttatttcaattcccaaaatcctctgcctcatcatcttcaaactgttaccacgtccatagggttgtcgaagagctaggaagagccttaccaagagcttcttcttcccctaacatttaggttggtaggagaagcaaaggaagagatcatttataatggctcctgcattcggaaaatgtttcatgttctgctgcgctaaaacctccccggaaaaagacgaaatggcaacggaatcgtacgaagccgccattaaaggactcaatgatcttctcagtacgaaagcggatctcggaaacgtcgccgccgcgaagatcaaagcgttgacggcggagctaaaggagcttgactcaagcaattcagacgcaattgaacgaatcaagaccggttttactcaattcaaaaccgagaaatatttgaagaatagtactttgttcaatcatcttgccaagactcagaccccaaagtttctggtgtttgcttgctctgattctcgagtttgtccatctcacatcttgaatttccaacctggtgaggcttttgttgtcagaaacatagccaatatggttccaccttttgaccagaagagacactctggagttggcgccgccgttgaatacgcagttgtacatctcaaggtggagaacattttggtgataggccatagctgctgtggtggtattaagggactcatgtccattgaagatgatgctgccccaactcaaagtgacttcattgaaaattgggtgaagataggcgcatcagcgaggaacaagatcaaggaggaacataaagacttgagctacgatgatcaatgcaacaagtgtgagaaggaagctgtgaacgtatcgcttggaaacttgctttcgtacccattcgtgagagctgaggtggtgaagaacacacttgcaataagaggaggtcactacaatttcgtcaaaggaacgtttgatctctgggagctcgatttcaagaccactcctgcttttgccttctcttaagaaagaaagctaccggaacatataaaactcttttgagataaaaaaagacactttgactcatctttcttcattctctcatgttgatgattcctctccaacttctttgatttctttttgttaattcaaaacttcaactttgctgcttctatttcaaaagctcaaacaataaagctgtaaccaacgtttgaaacttctatatttgtctaattgatgtttgaacgaagatttgaactttccttct

SEQ ID NO: 74 - DNA, 843 bp, Arabidopsis thaliana
  CDS (1)..(843)
atggctcctgcattcggaaaatgtttcatgttctgctgcgctaaaacctccccggaaaaagacgaaatggcaacggaatcgtacgaagccgccattaaaggactcaatgatcttctcagtacgaaagcggatctcggaaacgtcgccgccgcgaagatcaaagcgttgacggcggagctaaaggagcttgactcaagcaattcagacgcaattgaacgaatcaagaccggttttactcaattcaaaaccgagaaatatttgaagaatagtactttgttcaatcatcttgccaagactcagaccccaaagtttctggtgtttgcttgctctgattctcgagtttgtccatctcacatcttgaatttccaacctggtgaggcttttgttgtcagaaacatagccaatatggttccaccttttgaccagaagagacactctggagttggcgccgccgttgaatacgcagttgtacatctcaaggtggagaacattttggtgataggccatagctgctgtggtggtattaagggactcatgtccattgaagatgatgctgccccaactcaaagtgacttcattgaaaattgggtgaagataggcgcatcagcgaggaacaagatcaaggaggaacataaagacttgagctacgatgatcaatgcaacaagtgtgagaaggaagctgtgaacgtatcgcttggaaacttgctttcgtacccattcgtgagagctgaggtggtgaagaacacacttgcaataagaggaggtcactacaatttcgtcaaaggaacgtttgatctctgggagctcgatttcaagaccactcctgcttttgccttctcttaa

SEQ ID NO: 75 - protein, 280 aa, Arabidopsis thaliana
MAPAFGKCFMFCCAKTSPEKDEMATESYEAAIKGLNDLLSTKADLGNVAAAKIKALTAELKELDSSNSDAIERIKTGFTQFKTEKYLKNSTLFNHLAKTQTPKFLVFACSDSRVCPSHILNFQPGEAFVVRNIANMVPPFDQKRHSGVGAAVEYAVVHLKVENILVIGHSCCGGIKGLMSIEDDAAPTQSDFIENWVKIGASARNKIKEEHKDLSYDDQCNKCEKEAVNVSLGNLLSYPFVRAEVVKNTLAIRGGHYNFVKGTFDLWELDFKTTPAFAFS

SEQ ID NO: 76 - DNA, 1151 bp, Arabidopsis thaliana
caaaattcatgtgttagttcttcttctttacaaaattgagtttaaactgttttattactaatccaaatgaggaatcactttgcactattaatagaaaataatacacaaccaaacatctaaaagatactataatagtagagatcaaagacctgagcaaaaactgaaagaaaaaaaaaaaaaaaaaaaaagacttctcctcaaaaatggcgtttacactaggtggaagagctcgtcgtctagtctctgcaacatcagttcatcaaaatggttgcttacacaaactgcaacaaattggatcggatcggtttcagcttggtgaagcaaaagcaataagattactacccaggagaacaaacatggttcaagaattaggaatcagggaagaatttatggatctaaacagagaaacagagacaagttatgattttctggatgaaatgagacacagatttctgaaattcaagagacaaaagtatctaccggagatagaaaagtttaaagctttggccatagctcaatcaccaaaggtaatggtgataggatgtgcagattcaagggtatgtccatcttatgtactaggatttcaacctggtgaagcttttactatccgaaatgtcgccaatctcgttaccccggttcagaatggaccaacagaaaccaactcggctcttgagtttgcggtcaccactcttcaggttgagaacattatagttatgggtcatagcaattgtggaggaattgcagcacttatgagtcatcaaaaccaccaagggcaacactctagtttagtagaaaggtgggttatgaatgggaaagccgctaagttaagaacacaattagcttcatcacatttatcctttgatgaacaatgcagaaactgtgagaaggaatctataaaggattctgtgatgaatttgataacttattcatggataagagatagagtaaagagaggtgaagtcaagattcatggatgttattacaatttgtcagattgtagtcttgagaagtggagattaagttcagacaagactaactatggattctatatttcagacagagagatatggagttgagtaaatattgaacaatcctcagttctaatattcagatgtatctttgtacatacgaaatgatatttacacaattgg

SEQ ID NO: 77 - DNA, 873 bp, Arabidopsis thaliana
  CDS (1)..(873)
atggcgtttacactaggtggaagagctcgtcgtctagtctctgcaacatcagttcatcaaaatggttgcttacacaaactgcaacaaattggatcggatcggtttcagcttggtgaagcaaaagcaataagattactacccaggagaacaaacatggttcaagaattaggaatcagggaagaatttatggatctaaacagagaaacagagacaagttatgattttctggatgaaatgagacacagatttctgaaattcaagagacaaaagtatctaccggagatagaaaagtttaaagctttggccatagctcaatcaccaaaggtaatggtgataggatgtgcagattcaagggtatgtccatcttatgtactaggatttcaacctggtgaagcttttactatccgaaatgtcgccaatctcgttaccccggttcagaatggaccaacagaaaccaactcggctcttgagtttgcggtcaccactcttcaggttgagaacattatagttatgggtcatagcaattgtggaggaattgcagcacttatgagtcatcaaaaccaccaagggcaacactctagtttagtagaaaggtgggttatgaatgggaaagccgctaagttaagaacacaattagcttcatcacatttatcctttgatgaacaatgcagaaactgtgagaaggaatctataaaggattctgtgatgaatttgataacttattcatggataagagatagagtaaagagaggtgaagtcaagattcatggatgttattacaatttgtcagattgtagtcttgagaagtggagattaagttcagacaagactaactatggattctatatttcagacagagagatatggagttga

SEQ ID NO: 78 - protein, 290 aa, Arabidopsis thaliana
MAFTLGGRARRLVSATSVHQNGCLHKLQQIGSDRFQLGEAKAIRLLPRRTNMVQELGIREEFMDLNRETETSYDFLDEMRHRFLKFKRQKYLPEIEKFKALAIAQSPKVMVIGCADSRVCPSYVLGFQPGEAFTIRNVANLVTPVQNGPTETNSALEFAVTTLQVENIIVMGHSNCGGIAALMSHQNHQGQHSSLVERWVMNGKAAKLRTQLASSHLSFDEQCRNCEKESIKDSVMNLITYSWIRDRVKRGEVKIHGCYYNLSDCSLEKWRLSSDKTNYGFYISDREIWS

SEQ ID NO: 79 - DNA, 1319 bp, Arabidopsis thaliana
atgagactccgttcttttaaactcccaaatctttcaaccaatcccattattcacttaagtatatagtagcttccataagagtcttagttctaactataaatacacatatctcactctctctgatctccgcttctcttcgccaacaaatgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagctttcgaccccgtcgaaaccattaagcagggcttcatcaaattcaagaaggagaaatacgaaaccaaccctgctttgtacggtgagctcgcaaagggtcaaagtcctaagtacatggtgtttgcttgttcagactcacgtgtgtgtccatcacacgttctggactttcagccaggagatgccttcgtggtccgtaacatagccaacatggttcctcctttcgacaaggtcaaatacggtggcgttggagcagccattgaatacgcggtcttacaccttaaggtggagaacattgtggtgataggacacagtgcatgtggtgggatcaaagggcttatgtctttccccttagatggaaacaactccactgacttcatagaggactgggtcaaaatctgtttaccagccaagtcaaaggttatatcagaacttggagattcagcctttgaagatcaatgtggccgatgtgaaagggaggcggtgaatgtttcactagcaaacctattgacatatccatttgtgagagaaggacttgtgaagggaacacttgctttgaagggaggctactatgacttcgtcaagggtgcttttgagctttggggacttgaatttggcctctccgaaactagctctgttaaagatgtggctaccatactacattggaagctgtaggaaactctttgaagccttacccgatttcacattgtcaattcaataacaccaagttgttgtttacatgcagatcttgatgaaactggtttttgattttacagaattaaaatcttgggggacagaaatttg

SEQ ID NO: 80 - protein, 347 aa, Arabidopsis thaliana
MSTAPLSGFFLTSLSPSQSSLQKLSLRTSSTVACLPPASSSSSSSSSSSSRSVPTLIRNEPVFAAPAPIIAPYWSEEMGTEAYDEAIEALKKLLIEKEELKTVAAAKVEQITAALQTGTSSDKKAFDPVETIKQGFIKFKKEKYETNPALYGELAKGQSPKYMVFACSDSRVCPSHVLDFQPGDAFVVRNIANMVPPFDKVKYGGVGAAIEYAVLHLKVENIVVIGHSACGGIKGLMSFPLDGNNSTDFIEDWVKICLPAKSKVISELGDSAFEDQCGRCEREAVNVSLANLLTYPFVREGLVKGTLALKGGYYDFVKGAFELWGLEFGLSETSSVKDVATILHWKL

SEQ ID NO: 81 - DNA, 1444 bp, Arabidopsis thaliana
atgagactccgttcttttaaactcccaaatctttcaaccaatcccattattcacttaagtatatagtagcttccataagagtcttagttctaactataaatacacatatctcactctctctgatctccgcttctcttcgccaacaaatgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagctttcgaccccgtcgaaaccattaagcagggcttcatcaaattcaagaaggagaaatacgaaaccaaccctgctttgtacggtgagctcgcaaagggtcaaagtcctaagtacatggtgtttgcttgttcagactcacgtgtgtgtccatcacacgttctggactttcagccaggagatgccttcgtggtccgtaacatagccaacatggttcctcctttcgacaaggtcaaatacggtggcgttggagcagccattgaatacgcggtcttacaccttaaggtggagaacattgtggtgataggacacagtgcatgtggtgggatcaaagggcttatgtctttccccttagatggaaacaactccactgacttcatagaggactgggtcaaaatctgtttaccagccaagtcaaaggttatatcagaacttggagattcagcctttgaagatcaatgtggccgatgtgaaagggaggcggtgaatgtttcactagcaaacctattgacatatccatttgtgagagaaggacttgtgaagggaacacttgctttgaagggaggctactatgacttcgtcaagggtgcttttgagctttggggacttgaatttggcctctccgaaactagctctgtatgaaccaatccatcatcatcatcatcatcatgaccatccatcatcatcatcattattatcatcgtatataatatatatctaccccatatgtaatttgtaatgtgcctttgactgtgatgagttatctctccctctctaccaactttcttcatatatataaaacaaaaaggaaaagcagatgatatagatctttcgtggtttaattatgaacaattgtctttattatttgtgtatcaaatcggttgtatttatggtttgattttattttctatgttgtttggtaggttaaa

SEQ ID NO: 82 - protein, 336 aa, Arabidopsis thaliana
MSTAPLSGFFLTSLSPSQSSLQKLSLRTSSTVACLPPASSSSSSSSSSSSRSVPTLIRNEPVFAAPAPIIAPYWSEEMGTEAYDEAIEALKKLLIEKEELKTVAAAKVEQITAALQTGTSSDKKAFDPVETIKQGFIKFKKEKYETNPALYGELAKGQSPKYMVFACSDSRVCPSHVLDFQPGDAFVVRNIANMVPPFDKVKYGGVGAAIEYAVLHLKVENIVVIGHSACGGIKGLMSFPLDGNNSTDFIEDWVKICLPAKSKVISELGDSAFEDQCGRCEREAVNVSLANLLTYPFVREGLVKGTLALKGGYYDFVKGAFELWGLEFGLSETSSV

SEQ ID NO: 83 - DNA, 1353 bp, Arabidopsis thaliana
  CDS (112)..(1200)
ttgttcatttcctctgatgtcttggtgtcgttagatattgtctcccaaaaaagaaatcttcttgacacagagattgaagtcgcaaagagacagaggaaagagggggagaaaatggatcgaccagcagtgagtggtccaatggatttgccgattatgcacgatagtgataggtatgaactcgtcaaggatattggctccggtaattttggagttgcgagattgatgagagacaagcaaagtaatgagcttgttgctgttaaatatatcgagagaggtgagaagatagatgaaaatgtaaaaagggagataatcaaccacaggtccttaagacatcccaatatcgttagattcaaagaggttatattaacaccaacccatttagccattgttatggaatatgcatctggaggagaacttttcgagcgaatctgcaatgcaggccgcttcagcgaagacgaggcgaggtttttcttccagcaactcatttcaggagttagttactgtcatgctatgcaagtatgtcaccgagacttaaagctcgagaatacgttattagatggtagcccggcccctcgtctaaagatatgtgatttcggatattctaagtcatcagtgttacattcgcaaccaaaatcaactgttggaactcctgcttacatcgctcctgaggttttactaaagaaagaatatgatggaaaggttgcagatgtttggtcttgtggggttactctgtatgtcatgctggttggagcatatcctttcgaagatcccgaggaaccaaagaatttcaggaaaactatacatagaatcctgaatgttcagtatgctattccggattatgttcacatatctcctgaatgtcgccatttgatctccagaatatttgttgctgaccctgcaaagaggatatcaattcctgaaataaggaaccatgaatggtttctaaagaatctaccggcagatctaatgaacgataacacgatgaccactcagtttgatgaatcggatcaaccgggccaaagcatagaagaaattatgcagatcattgcagaagcaactgttcctcctgcaggcactcagaatctgaaccattacctcacaggaagcttggacatagatgacgatatggaggaagacttagagagcgaccttgatgatcttgacatcgacagtagcggagagattgtgtacgcaatgtgatactatatatctatttgcatggtttctgctacaaaaatgtcaaacaaaaaatgttgaagaataagattaagatgttttgcttgctattgagttggcccaactttgtctcaatgagtacactttgaatctttgatatgcaaaagactaaatttc

SEQ ID NO: 84 - protein, 362 aa, Arabidopsis thaliana
MDRPAVSGPMDLPIMHDSDRYELVKDIGSGNFGVARLMRDKQSNELVAVKYIERGEKIDENVKREIINHRSLRHPNIVRFKEVILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKVADVWSCGVTLYVMLVGAYPFEDPEEPKNFRKTIHRILNVQYAIPDYVHISPECRHLISRIFVADPAKRISIPEIRNHEWFLKNLPADLMNDNTMTTQFDESDQPGQSIEEIMQIIAEATVPPAGTQNLNHYLTGSLDIDDDMEEDLESDLDDLDIDSSGEIVYAM

SEQ ID NO: 85 - DNA, 1702 bp, Arabidopsis thaliana
  CDS (605)..(1549)
agagaaagctgtttcctttttatattgacagagaaaaggaaagctgatagagagagagacagagagagagaaacagagttcaagatcacgagccttccttcttcttcttcttcttcatcgagagcgatcaaaggaacaaaaaggatctcaagaaacccacttgtgttgttggttagatacttcacgggtctctgaaaacgtctctttctcacaaccataacttgatcacccaatactccttttctcatcttaaaggctcaaattcatccacgtcacaccgttgttcatttcctctgatgtcttggtgtcgttagatattgtctcccaaaaaagaaatcttcttgacacagagattgaagtcgcaaagagacagaggaaagagggggagaaaatggatcgaccagcagtgagtggtccaatggatttgccgattatgcacgatagtgataggtatgaactcgtcaaggatattggctccggtaattttggagttgcgagattgatgagagacaagcaaagtaatgagcttgttgctgttaaatatatcgagagagtgttgttttaaaggctctaggtgtttcttttgttatggaacgtggtattaatggtgggactttttgtatttgtacagatagatgaaaatgtaaaaagggagataatcaaccacaggtccttaagacatcccaatatcgttagattcaaagaggttatattaacaccaacccatttagccattgttatggaatatgcatctggaggagaacttttcgagcgaatctgcaatgcaggccgcttcagcgaagacgaggcgaggtttttcttccagcaactcatttcaggagttagttactgtcatgctatgcaagtatgtcaccgagacttaaagctcgagaatacgttattagatggtagcccggcccctcgtctaaagatatgtgatttcggatattctaagtcatcagtgttacattcgcaaccaaaatcaactgttggaactcctgcttacatcgctcctgaggttttactaaagaaagaatatgatggaaaggttgcagatgtttggtcttgtggggttactctgtatgtcatgctggttggagcatatcctttcgaagatcccgaggaaccaaagaatttcaggaaaactatacatagaatcctgaatgttcagtatgctattccggattatgttcacatatctcctgaatgtcgccatttgatctccagaatatttgttgctgaccctgcaaagaggatatcaattcctgaaataaggaaccatgaatggtttctaaagaatctaccggcagatctaatgaacgataacacgatgaccactcagtttgatgaatcggatcaaccgggccaaagcatagaagaaattatgcagatcattgcagaagcaactgttcctcctgcaggcactcagaatctgaaccattacctcacaggaagcttggacatagatgacgatatggaggaagacttagagagcgaccttgatgatcttgacatcgacagtagcggagagattgtgtacgcaatgtgatactatatatctatttgcatggtttctgctacaaaaatgtcaaacaaaaaatgttgaagaataagattaagatgttttgcttgctattgagttggcccaactttgtctcaatgagtacactttgaatctttgatatgcaaaagactaaatttc

SEQ ID NO: 86 - protein, 314 aa, Arabidopsis thaliana
MVGLFVFVQIDENVKREIINHRSLRHPNIVRFKEVILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKVADVWSCGVTLYVMLVGAYPFEDPEEPKNFRKTIHRILNVQYAIPDYVHISPECRHLISRIFVADPAKRISIPEIRNHEWFLKNLPADLMNDNTMTTQFDESDQPGQSIEEIMQIIAEATVPPAGTQNLNHYLTGSLDIDDDMEEDLESDLDDLDIDSSGEIVYAM

SEQ ID NO: 87 - DNA, 1514 bp, Arabidopsis thaliana
  CDS (286)..(1281)
aaatagagaagctcttcaagtatccgatgtttttgtttaatcaacaagaggcggagatacgggagaaattgcatgtgtaatcataaaatgtagatgttagcttcgtcgtttttactatagtttagttctcttcttcttcttttttcgtcattacaatctctttcttaatttacttcttcttgatagtataattaagttgtttgtaataatctgtacaaagatgttgtgttctcataaaaaattcaattttgtaaagaagctctacatgttccttgctctgtaaacatggtccccttttggactacagtttctcgaaatggctcatcagactcagagacgactctccaatctgcttcaaaagccacaaaacagtataaatatccttctcttcgtccctctcatcgcctgtctctcctcttcctcttcccgttccatttatccgcaaacggagcttgttttcggtgcacctgcttcagccacttcaaacttgaactgagaaggatgggaaacgaatcatatgaagacgccatcgaagctctcaagaagcttctcattgagaaggatgatctgaaggatgtagctgcggccaaggtgaagaagatcacggcggagcttcaggcagcctcgtcatcggacagcaaatcttttgatcccgtcgaacgaattaaggaaggcttcgtcaccttcaagaaggagaaatacgagaccaatcctgctttgtatggtgagctcgccaaaggtcaaagcccaaagtacatggtgtttgcttgttcggactcacgagtgtgcccatcacacgtactagacttccatcctggagatgccttcgtggttcgtaatatcgccaatatggttcctccttttgacaaggtcaaatatgcaggagttggagccgccattgaatacgctgtcttgcaccttaaggtggaaaacattgtggtgatagggcacagtgcatgtggtggcatcaaggggcttatgtcatttcctcttgacggaaacaactctactgacttcatagaggattgggtcaaaatctgtttaccagcaaagtcaaaagttttggcagaaagtgaaagttcagcatttgaagaccaatgtggccgatgcgaaagggaggcagtgaatgtgtcactagcaaacctattgacatatccatttgtgagagaaggagttgtgaaaggaacacttgctttgaagggaggctactatgactttgttaatggctcctttgagctttgggagctccagtttggaatttcccccgttcattctatatgaactaacacatcaccatcaccatcgctaccaccaccatcacaaacatcatcatcgtcgtcatcatcatgatcagcatcttcatatataaatgttttactcttatttaattgctacttgtaatggtatacatttacttgcgatgagcttcttttccttcattatccagttataaaataaataaataaatcatgtttactttcacagatatcgttttgctgaagttgctttgattt

SEQ ID NO: 88 - protein, 331 aa, Arabidopsis thaliana
MVPFWTTVSRNGSSDSETTLQSASKATKQYKYPSLRPSHRLSLLFLFPFHLSANGACFRCTCFSHFKLELRRMGNESYEDAIEALKKLLIEKDDLKDVAAAKVKKITAELQAASSSDSKSFDPVERIKEGFVTFKKEKYETNPALYGELAKGQSPKYMVFACSDSRVCPSHVLDFHPGDAFVVRNIANMVPPFDKVKYAGVGAAIEYAVLHLKVENIVVIGHSACGGIKGLMSFPLDGNNSTDFIEDWVKICLPAKSKVLAESESSAFEDQCGRCEREAVNVSLANLLTYPFVREGVVKGTLALKGGYYDFVNGSFELWELQFGISPVHSI

SEQ ID NO: 89 - DNA, 1031 bp, Arabidopsis thaliana
  CDS (63)..(755)
atgcagtaatctgataaaaccctccacagagatttccaacaaaacaggaactaaaacacaagatgaagattatgatgatgattaagctctgcttcttctccatgtccctcatctgcattgcacctgcagatgctcagacagaaggagtagtgtttggatataaaggcaaaaatggaccaaaccaatggggacacttaaaccctcacttcaccacatgcgcggtcggtaaattgcaatctccaattgatattcaaaggaggcaaatattttacaaccacaaattgaattcaatacaccgtgaatactacttcacaaacgcaacactagtgaaccacgtctgtaatgttgccatgttcttcggggagggagcaggagatgtgataatagaaaacaagaactataccttactgcaaatgcattggcacactccttctgaacatcacctccatggagtccaatatgcagctgagctgcacatggtacaccaagcaaaagatggaagctttgctgtggtggcaagtctcttcaaaatcggcactgaagagcctttcctctctcagatgaaggagaaattggtgaagctaaaggaagagagactcaaagggaaccacacagcacaagtggaagtaggaagaatcgacacaagacacattgaacgtaagactcgaaagtactacagatacattggttcactcactactcctccttgctccgagaacgtttcttggaccatccttggcaaggtgaggtcaatgtcaaaggaacaagtagaactactcagatctccattggacacttctttcaagaacaattcaagaccgtgtcaacccctcaacggccggagagttgagatgttccacgaccacgagcgtgtcgataaaaaagaaaccggtaacaaaaagaaaaaacccaattaaaatagttttacattgtctattggtttgtttagaaccctaattagctttgtaaaactaataatctcttatgtagtactgtgttgttgtttacgacttgatatacgatttccaaat

SEQ ID NO: 90 - protein, 231 aa, Arabidopsis thaliana
MKIMMMIKLCFFSMSLICIAPADAQTEGVVFGYKGKNGPNQWGHLNPHFTTCAVGKLQSPIDIQRRQIFYNHKLNSIHREYYFTNATLVNHVCNVAMFFGEGAGDVIIENKNYTLLQMHWHTPSEHHLHGVQYAAELHMVHQAKDGSFAVVASLFKIGTEEPFLSQMKEKLVKLKEERLKGNHTAQVEVGRIDTRHIERKTRKYYRYIGSLTTPPCSENVSWTILGKVRSM

SEQ ID NO: 91 - DNA, 736 bp, Arabidopsis thaliana
  CDS (1)..(654)
atggatgaatatgtagaggatgaacacgaattcagctacgaatggaaccaagagaacgggccagcgaaatggggaaagctaagaccggaatggaaaatgtgcggaaaaggagaaatgcaatcgcctattgatcttatgaacaaaagagttagacttgttactcatcttaaaaagcttactagacactacaaaccttgtaacgccactctcaaaaatagaggccatgatatgatgctgaaatttggagaagaagggtcagggagtattacggtcaatggaactgagtataaactcttacagcttcattggcattctccctctgaacatactatgaatggaagaaggtttgctctcgagctacacatggttcacgaaaacattaacggaagtttggctgtagtcacagtcctctacaaaatcggaaggccagattcttttctcggattgctggaaaataaattgtcggcaattacagatcaaaatgaggcggagaaatatgtagatgtgattgacccaagggatattaagattgggagcagaaaattttatagatacattggatcacttactactcctccttgtacgcaaaatgttatttggaccgtcgttaaaaaggtaaatactcatcgttattttcttctcttttttacttaatcaaacatagcattaatagatcattacaaggtactaatagtgtgaatatccatatccaaaaggtttatccatctacatgtta

SEQ ID NO: 92 - protein, 217 aa, Arabidopsis thaliana
MDEYVEDEHEFSYEWNQENGPAKWGKLRPEWKMCGKGEMQSPIDLMNKRVRLVTHLKKLTRHYKPCNATLKNRGHDMMLKFGEEGSGSITVNGTEYKLLQLHWHSPSEHTMNGRRFALELHMVHENINGSLAVVTVLYKIGRPDSFLGLLENKLSAITDQNEAEKYVDVIDPRDIKIGSRKFYRYIGSLTTPPCTQNVIWTVVKKVNTHRYFLLFFT

SEQ ID NO: 93 - DNA, 1134 bp, Arabidopsis thaliana
  CDS (48)..(881)
aaaacacattctgagaagaagaagaagaaaataagaaaaaacaaaagatgaaaaccattatcctttttgtaacatttcttgctctttcttcttcatctctagccgatgagacagagactgaatttcattacaaacccggtgagatagccgatccctcgaaatggagcagtatcaaggctgaatggaaaatttgcgggacagggaagaggcaatcgccaatcaatcttactccaaaaatagctcgcattgttcacaattctacagagattcttcagacatattacaaacctgtagaggctattcttaagaaccgtggattcgacatgaaggttaagtgggaagacgatgcagggaagatcgtgatcaatgataccgactataaattggttcaaagccactggcacgcaccttcagagcattttctcgatggacagaggttggcaatggaacttcacatggtacacaaaagtgtagaagggcacttggcagtgattggagttctcttcagagaaggagaaccaaatgctttcatttcgcggatcatggacaagatccataagatcgcagacgtacaagatggagaggtcagcatcggaaagatagatccaagagaatttggatgggatcttacaaagttttatgaatacagaggttctctcacgactcctccttgcacggaagatgtcatgtggaccatcatcaacaaggtggggactgtttcacgtgagcaaattgatgtattgacagatgctcgtcgcggtggttatgagaagaacgcgagaccagctcaacctctgaacggacgtctggtttatttaaacgagcagtccagtccaagtccaactccacggctaagaataccacgagttggtccggtctaagacagtcttataggacaaggcaactccgagccctaatttccatacaaagaaaattcggaaaagaattttgaagatgtatgaaaattgggagccataactatttttttttaactattcttttgattaaaagataaaactacgcaatattatatgcataaagtttttcttttatacatgtattccaataaacaagatgtaataatatccaaccataatgagttgtttgattattttataacacaagatctctcac

SEQ ID NO: 94 - protein, 277 aa, Arabidopsis thaliana
MKTIILFVTFLALSSSSLADETETEFHYKPGEIADPSKWSSIKAEWKICGTGKRQSPINLTPKIARIVHNSTEILQTYYKPVEAILKNRGFDMKVKWEDDAGKIVINDTDYKLVQSHWHAPSEHFLDGQRLAMELHMVHKSVEGHLAVIGVLFREGEPNAFISRIMDKIHKIADVQDGEVSIGKIDPREFGWDLTKFYEYRGSLTTPPCTEDVMWTIINKVGTVSREQIDVLTDARRGGYEKNARPAQPLNGRLVYLNEQSSPSPTPRLRIPRVGPV

SEQ ID NO: 95 - DNA, 804 bp, Arabidopsis thaliana
  CDS (1)..(804)
atggataccaacgcaaaaacaattttcttcatggctatgtgtttcatctatctatctttccctaatatttcacacgctcattctgaagtcgacgacgaaactccatttacttacgaacaaaaaacggaaaagggaccagagggatggggcaaaataaatccgcactggaaagtttgtaacaccggaagatatcaatccccgatcgatcttactaacgaaagagtcagtcttattcatgatcaagcatggacaagacaatataaaccagctccggctgtaattacaaacagaggccatgacattatggtatcatggaaaggagatgctgggaagatgacaatacggaaaacggattttaatttggtgcaatgccattggcattcaccttctgagcataccgttaacggaactaggtacgacctagagcttcacatggttcacacgagtgcacgaggcagaactgcggttatcggagttctttacaaattaggcgaacctaatgaattcctcaccaagctactaaatggaataaaagcagtgggaaataaagagataaatctagggatgattgatccacgagagattaggtttcaaacaagaaaattctatagatacattggctctctcactgttcctccttgcactgaaggcgtcatttggactgtcgtcaaaagggtgaacacaatatcaatggagcaaattacagctcttaggcaagccgttgacgatggatttgagacaaattcaagaccggttcaagactcaaagggaagatcagtttggttctatgatccaaatgtttga

SEQ ID NO: 96 - protein, 267 aa, Arabidopsis thaliana
MDTNAKTIFFMAMCFIYLSFPNISHAHSEVDDETPFTYEQKTEKGPEGWGKINPHWKVCNTGRYQSPIDLTNERVSLIHDQAWTRQYKPAPAVITNRGHDIMVSWKGDAGKMTIRKTDFNLVQCHWHSPSEHTVNGTRYDLELHMVHTSARGRTAVIGVLYKLGEPNEFLTKLLNGIKAVGNKEINLGMIDPREIRFQTRKFYRYIGSLTVPPCTEGVIWTVVKRVNTISMEQITALRQAVDDGFETNSRPVQDSKGRSVWFYDPNV

SEQ ID NO: 97 - DNA, 1088 bp, Arabidopsis thaliana
  CDS (114)..(947)
gatcaacatctccttgaagttgtttcataagaataagagctataaaagaggataaaaccaaaatttgaatttttttcttctatctctctccccaagatatatagcacaagaaaatgaagataccatcaattggctatgtctttttccttatcttcatctctattacaattgtttcgagttcaccagatcatggagaagttgaggacgaaacgcagtttaactacgagaagaaaggagagaaggggccagagaactggggaagactaaagccagagtgggcaatgtgtggaaaaggcaacatgcagtctccgattgatcttacggacaaaagagtcttgattgatcataatcttggataccttcgtagccagtatttaccttcaaatgccaccattaagaacagaggccatgatatcatgatgaaatttgaaggaggaaatgcaggtttaggtatcactattaatggtactgaatataaacttcaacagattcattggcactctccttccgaacacacactcaatggcaaaaggtttgttcttgaggaacacatggttcatcagagcaaagatggacgcaacgctgttgtcgctttcttttacaaattgggaaaacctgactattttctcctcacgttggaaagatacttgaagaggataactgatacacacgaatcccaggaatttgtcgagatggttcatcctagaacattcggttttgaatcaaaacactattatagatttatcggatcacttacaactccaccgtgttctgaaaatgtgatttggacgatttccaaagagatgaggactgtgacattaaaacaattgatcatgcttcgagtgactgtacacgatcaatctaactcaaatgctagaccgcttcagcgtaaaaatgagcgtccggtggcactttacataccaacatggcatagtaaactatattaaatatttaagtttggtttatattctttctagtaatctttgaaatattgtaagagataatgcttctaataaataacattggatttattggaattaatgtattgaaaaaactatgcaaatactacagtgtattttggaacgacc

SEQ ID NO: 98 - protein, 277 aa, Arabidopsis thaliana
MKIPSIGYVFFLIFISITIVSSSPDHGEVEDETQFNYEKKGEKGPENWGRLKPEWAMCGKGNMQSPIDLTDKRVLIDHNLGYLRSQYLPSNATIKNRGHDIMMKFEGGNAGLGITINGTEYKLQQIHWHSPSEHTLNGKRFVLEEHMVHQSKDGRNAVVAFFYKLGKPDYFLLTLERYLKRITDTHESQEFVEMVHPRTFGFESKHYYRFIGSLTTPPCSENVIWTISKEMRTVTLKQLIMLRVTVHDQSNSNARPLQRKNERPVALYIPTWHSKLY

SEQ ID NO: 99 - DNA, 783 bp, Arabidopsis thaliana
  CDS (1)..(783)
atggatgccaacacaaaaacaattttattttttgtagtgttcttcatcgatttattttcccctaatattttattcgtttatgctcgtgaaatcggcaacaaaccgctatttacatacaaacaaaaaacagagaaaggaccagcggaatggggcaaattagaccctcaatggaaagtttgtagcaccggaaaaattcaatctccgattgatctcactgacgaaagagtcagtcttattcatgatcaagccttgagtaaacattacaaaccagcttcggctgtaattcaaagtagaggacatgacgttatggtatcgtggaaaggagatggtgggaaaataacaatacatcaaacggattataaattggtgcagtgccattggcattcaccgtctgagcataccattaacggaactagctatgacctagagcttcacatggttcacacgagtgctagtggcaaaaccactgtggttggagttctttataaattaggtgaacctgatgaattcctcacaaagatactaaatggaataaaaggagtagggaaaaaagagatagatctaggaatcgtggatcctcgagatattagatttgaaaccaacaatttctatagatacattggctctctcactattcctccatgcaccgaaggcgttatttggaccgtccagaaaagggtattatattttttttgtttctgttatagattaattatcttcgttacaccttacataaacattttttggatttttgtttttgtattttggtgtatgctaatgtaa

SEQ ID NO: 100 - protein, 260 aa, Arabidopsis thaliana
MDANTKTILFFVVFFIDLFSPNILFVYAREIGNKPLFTYKQKTEKGPAEWGKLDPQWKVCSTGKIQSPIDLTDERVSLIHDQALSKHYKPASAVIQSRGHDVMVSWKGDGGKITIHQTDYKLVQCHWHSPSEHTINGTSYDLELHMVHTSASGKTTVVGVLYKLGEPDEFLTKILNGIKGVGKKEIDLGIVDPRDIRFETNNFYRYIGSLTIPPCTEGVIWTVQKRVLYFFCFCYRLIIFVTPYINIFWIFVFVFWCMLM

SEQ ID NO: 101 - DNA, 859 bp, Arabidopsis thaliana
  CDS (1)..(828)
atggtgaactactcatcaatcagttgcatcttctttgtggctctgtttagtattttcacaattgtttcgatttcgagtgctgcttcaagtcacggagaagttgaggacgaacgcgagtttaactacaagaagaacgatgagaaggggccagagagatggggagaacttaaaccggaatgggaaatgtgtggaaaaggagagatgcaatctcccatagatcttatgaacgagagagttaacattgtttctcatcttggaaggcttaatagagactataatccttcaaatgcaactcttaagaacagaggccatgacatcatgttaaaatttgaagatggagcaggaactattaagatcaatggttttgaatatgaacttcaacagcttcactggcactctccgtctgaacatactattaatggaagaaggtttgcacttgagctgcatatggttcacgaaggcaggaatagaagaatggctgttgtgactgtgttgtacaagatcggaagagcagatacttttatcagatcgttggagaaagaattagagggcattgctgaaatggaggaggctgagaaaaatgtaggaatgattgatcccaccaaaattaagatcggaagcagaaaatattacagatacactggttcacttaccactcctccttgcactcaaaacgttacttggagcgtcgttagaaaggttaggaccgtgacaagaaaacaagtgaagctcctccgcgtggcagtgcacgatgatgctaattcgaatgcgaggccggttcaaccaaccaacaagcgcatagtgcacttatacagaccaatagtttaatatatgaagatactgaaagcttttactaatc

SEQ ID NO: 102 - protein, 275 aa, Arabidopsis thaliana
MVNYSSISCIFFVALFSIFTIVSISSAASSHGEVEDEREFNYKKNDEKGPERWGELKPEWEMCGKGEMQSPIDLMNERVNIVSHLGRLNRDYNPSNATLKNRGHDIMLKFEDGAGTIKINGFEYELQQLHWHSPSEHTINGRRFALELHMVHEGRNRRMAVVTVLYKIGRADTFIRSLEKELEGIAEMEEAEKNVGMIDPTKIKIGSRKYYRYTGSLTTPPCTQNVTWSVVRKVRTVTRKQVKLLRVAVHDDANSNARPVQPTNKRIVHLYRPIV

SEQ ID NO: 103 - DNA, 1053 bp, Arabidopsis thaliana
  CDS (1)..(1053)
atgaagatatcatcactaggatgggtcttagtccttatcttcatctctattaccattgtttcgagtgcaccagcacctaaacctcctaaacctaagcctgcaccagcacctacacctcctaaacctaagcccacaccagcacctacacctcctaaacctaagcccaaaccagcacctacacctcctaaacctaagcctgcaccagcacctacacctcctaaacctaagcccgcaccagcacctacacctcctaaacctaagcccaaaccagcacctacacctcctaatcctaagcccacaccagcacctacacctcctaaacctaagcctgcaccagcaccagcaccaacaccagcaccgaaacctaaacctgcacctaaaccagcaccaggtggagaagttgaggacgaaaccgagtttagctacgagacgaaaggaaacaaggggccagcgaaatggggaacactagatgcagagtggaaaatgtgtggaataggcaaaatgcaatctcctattgatcttcgggacaaaaatgtggtagttagtaataaatttggattgcttcgtagccagtatctgccttctaataccaccattaagaacagaggtcatgatatcatgttgaaattcaaaggaggaaataaaggtattggtgtcactatccgtggtactagatatcaacttcaacaacttcattggcactctccttccgaacatacaatcaatggcaaaaggtttgcgctagaggaacacttggttcatgagagcaaagataaacgctacgctgttgtcgcattcttatacaatctcggagcatctgacccttttctcttttcgttggaaaaacaattgaagaagataactgatacacatgcgtccgaggaacatattcgcactgtgtcaagtaaacaagtgaagcttctccgtgtggctgtacacgatgcttcagattcaaatgccaggccgcttcaagcagtcaataagcgcaaggtatatttatacaaaccaaaggttaagttaatgaagaaatactgtaatataagttcttactag

SEQ ID NO: 104 - protein, 350 aa, Arabidopsis thaliana
MKISSLGWVLVLIFISITIVSSAPAPKPPKPKPAPAPTPPKPKPTPAPTPPKPKPKPAPTPPKPKPAPAPTPPKPKPAPAPTPPKPKPKPAPTPPNPKPTPAPTPPKPKPAPAPAPTPAPKPKPAPKPAPGGEVEDETEFSYETKGNKGPAKWGTLDAEWKMCGIGKMQSPIDLRDKNVVVSNKFGLLRSQYLPSNTTIKNRGHDIMLKFKGGNKGIGVTIRGTRYQLQQLHWHSPSEHTINGKRFALEEHLVHESKDKRYAVVAFLYNLGASDPFLFSLEKQLKKITDTHASEEHIRTVSSKQVKLLRVAVHDASDSNARPLQAVNKRKVYLYKPKVKLMKKYCNISSY

SEQ ID NO: 105 - DNA, 996 bp, Arabidopsis thaliana
  CDS (90)..(866)
ctagagagcatcttcttatatcaactaaactttgtattcatttccaagtatcactctaaatcatctttttcgaattcgcctcccaagatatgtcgacagagtcgtacgaagacgccattaaaagactcggagagcttctcagtaagaaatcggatctcgggaacgtggcagccgcaaagatcaagaagttaacggatgagttagaggaacttgattccaacaagttagatgccgtagaacgaatcaaatccggatttctccatttcaagactaataattatgagaagaatcctactttgtacaattcacttgccaagagccagacccccaagtttttggtgtttgcttgtgcggattcacgagttagtccatctcacatcttgaatttccaacttggggaagccttcatcgttagaaacattgcaaacatggtgccaccttatgacaagacaaagcactctaatgttggtgcggcccttgaatatccaattacagtcctcaacgtggagaacattcttgttattggacacagctgttgtggtggaataaagggactcatggccattgaagataatacagctcccactaagaccgagttcatagaaaactggatccagatctgtgcaccggccaagaacaggatcaagcaggattgtaaagacctaagctttgaagatcagtgcaccaactgtgagaaggaagccgtgaacgtgtccttggggaatcttttgtcttacccattcgtgagagaaagagtggtgaagaacaagcttgccataagaggagctcactatgatttcgtaaaaggaacgtttgatctttgggaacttgacttcaagactacccctgcctttgccttgtcttaaaagattcctcctactcaaatattttctctatgttgtttctaattatgttcttataatcttcttctgttgcttctgtaatgtcatctttgctacttctattccaatagaaatgaataaagctttaaagagc

SEQ ID NO: 106 - protein, 258 aa, Arabidopsis thaliana
MSTESYEDAIKRLGELLSKKSDLGNVAAAKIKKLTDELEELDSNKLDAVERIKSGFLHFKTNNYEKNPTLYNSLAKSQTPKFLVFACADSRVSPSHILNFQLGEAFIVRNIANMVPPYDKTKHSNVGAALEYPITVLNVENILVIGHSCCGGIKGLMAIEDNTAPTKTEFIENWIQICAPAKNRIKQDCKDLSFEDQCTNCEKEAVNVSLGNLLSYPFVRERVVKNKLAIRGAHYDFVKGTFDLWELDFKTTPAFALS

SEQ ID NO: 107 - DNA, 1362 bp, Arabidopsis thaliana
  CDS (193)..(1098)
attgttgtgtaaaactcttgttcctcttcctcttcaacgtgaacacttctatttctcagagaacattcacctatatgtctttcttcaaggagaagtcttcctctttccagatttagatgaacactcttcagatgccttgtgccttattgatccagattcgaagtacccaactttactctctagacctttttcatggcagccactcccacacacttctctgtctcccatgatcctttttcttccacgtctctccttaatctccaaactcaagcgatctttggtcccaatcacagtttaaagacaacccagttgagaattccagcttctttcagaagaaaagctacaaacttgcaagtgatggcttcaggaaagacacctggactgactcaggaagctaatggggttgcaattgatagacaaaacaacactgatgtatttgacgacatgaaacagcggttcctggccttcaagaagcttaagtacatcagggatgactttgaacactacaaaaatctggcagatgctcaagctccaaagtttctggtgattgcttgtgcagactctagagtttgtccttctgctgtcctgggattccaaccgggtgacgcattcactgttcgtaacattgcaaatttagtacctccatatgagtctggacctactgaaaccaaagctgctctagagttctctgtgaatactcttaatgtggaaaacatcttagtcattggtcatagccggtgtggaggaattcaagctttaatgaaaatggaagacgaaggagattccagaagtttcatacacaactgggtagttgtgggaaagaaggcaaaggaaagcacaaaagctgttgcttcaaacctccattttgatcatcagtgccaacattgtgaaaaggcatcgataaatcattcattagaaaggctgcttgggtacccgtggatagaagagaaagtgcggcaaggttcactgtctctccatggtggatactataattttgttgattgtacgttcgagaaatggacagtggattatgcagcaagcagaggtaagaagaaggaaggcagtggaatcgctgttaaagaccggtcagtttggtcttgacttacgactatctcaatcttcatagagttttttttcataatttatagagaaacatcaaaccccttttggttgggattatcatgtgtttgttccacttgtgtgttgaagtcattttccttcttctgtcttattgaggcagggactaatgtttgttttatctttcagttgtttcgtttaaattccacatttgtgcaatgaactggttggtgtttctttaagatataatcattttgccactgtagtgagatcggaggcatgcat

SEQ ID NO: 108 - protein, 302 aa, Arabidopsis thaliana
MAATPTHFSVSHDPFSSTSLLNLQTQAIFGPNHSLKTTQLRIPASFRRKATNLQVMASGKTPGLTQEANGVAIDRQNNTDVFDDMKQRFLAFKKLKYIRDDFEHYKNLADAQAPKFLVIACADSRVCPSAVLGFQPGDAFTVRNIANLVPPYESGPTETKAALEFSVNTLNVENILVIGHSRCGGIQALMKMEDEGDSRSFIHNWVVVGKKAKESTKAVASNLHFDHQCQHCEKASINHSLERLLGYPWIEEKVRQGSLSLHGGYYNFVDCTFEKWTVDYAASRGKKKEGSGIAVKDRSVWS

SEQ ID NO: 109 - DNA, 1366 bp, Arabidopsis thaliana
  CDS (175)..(1002)
atattaaaccactgtaactgtaatttattgtttcgccgtcccggaatgttcctgttgaaatccattttcgctgattttttttcttccgtctcttcttcagcttcgaccattttcgtcttcttcattcagtgttgagtcctcgtttacctgtgagctcgaagaaagtgacgatcaatgggaaccctaggcagagcattttactcggtcggtttttggatccgtgagactggtcaagctcttgatcgcctcggttgtcgccttcaaggcaaaaattacttccgagaacaactgtcaaggcatcggacactgatgaatgtatttgataaggctccgattgtggacaaggaagcttttgtggcaccaagcgcctcagttattggggacgttcacattggaagaggatcgtccatttggtatggatgcgtattacgaggcgatgtgaacaccgtaagtgttgggtcaggaactaatattcaggacaactcacttgtgcatgtggcaaaatcaaacttaagcgggaaggtgcacccaaccataattggagacaatgtaaccattggtcatagtgctgttttacatggatgtactgttgaggatgagacctttattgggatgggtgcgacacttcttgatggggtcgttgttgaaaagcatgggatggttgctgctggtgcacttgtacgacaaaacaccagaattccttctggagaggtatggggaggaaacccagcaaggttcctcaggaagctcactgatgaggaaattgcttttatctctcagtcagcaacaaactactcaaacctcgcacaggctcacgctgcagagaatgcaaagccattaaatgtgattgagttcgagaaggttctacgcaagaagcatgctctaaaggacgaggagtatgactcaatgctcggaatagtgagagaaactccaccagagcttaacctccctaacaacatactgcctgataaagaaaccaagcgtccttctaatgtgaactgatttttcaggggtatgttttctggccgaagccctacagggtgagatactcaaggggattatgtttcggtctctggtttgaatatggcaggtagagtacattagggtagacggatttacagcttttgaagaagctatgttcaacattttttcatggtttcttagggagtattattgtctaatcaaactttgtatgttatcacttcggtcttttgaacgtaagaatcaagttcatgaaacatgagtgaatattagtctgatgcatgtgcgtatgcaaaaatccatgtgcgcctatgttgctaggcaagcatgaagaataaagatccaaactggatatatcatatatttatctttttataattactgc

SEQ ID NO: 110 - protein, 275 aa, Arabidopsis thaliana
MGTLGRAFYSVGFWIRETGQALDRLGCRLQGKNYFREQLSRHRTLMNVFDKAPIVDKEAFVAPSASVIGDVHIGRGSSIWYGCVLRGDVNTVSVGSGTNIQDNSLVHVAKSNLSGKVHPTIIGDNVTIGHSAVLHGCTVEDETFIGMGATLLDGVVVEKHGMVAAGALVRQNTRIPSGEVWGGNPARFLRKLTDEEIAFISQSATNYSNLAQAHAAENAKPLNVIEFEKVLRKKHALKDEEYDSMLGIVRETPPELNLPNNILPDKETKRPSNVN

SEQ ID NO: 111 - DNA, 1185 bp, Arabidopsis thaliana
  CDS (138)..(974)
cgaactcactcgagttaaaaaaaaaaatcctcccatcaatacgcctccataaacctctctctatctggtggagcgacaccaaaaacaacaaagccttctcattttcacactttgggtaatcggagaatcacaaaaaaatgggaaccctaggacgagcaatttacactgtgggtaactggattcgtggaactggtcaagctcttgatcgcgttggttctcttcttcaaggaagtcaccgtatcgaggaacatctgtcgaggcatcggacgttgatgaatgtgtttgataaatcaccattggtggataaagatgtgtttgtggctccgagtgcttctgttattggtgatgttcagatcggaaaaggctcgtcgatttggtatggctgtgttcttcgaggtgatgtgaataacatcagtgttggatctgggacgaatatccaagataatacgcttgtacatgttgcaaagaccaacataagtggcaaggttctacctactctgattggggacaatgtaacagtaggtcacagtgctgtcattcatgggtgtactgttgaggatgatgcttttgttggtatgggagcaacactacttgatggtgtggtggttgagaaacatgccatggttgctgctggttctcttgtgaaacagaacacgcgaatcccttctggagaggtgtggggaggaaatccagcaaagttcatgagaaagttaacagatgaagagatagtatacatctcacagtcagcaaagaattacatcaatctcgcacagattcacgcctcagagaattcaaagtcatttgagcagatcgaggttgagagagcgcttaggaagaagtatgcacgcaaggacgaggattacgattcaatgcttgggattacccgtgaaactccaccggagttgattcttcccgacaatgtcttaccaggtggtaaacccgtcgccaaggttccgtctactcagtacttctaattccaatctcaggttgtttttgtgtgttgaaatcatttcaagacaggattgattctctggaaggtcaagagagatattattttggttttaacttttcttccgagcaagcaggagatttatcatccttgctcaataatgtatggttgcattatgaagtcatttcttcgaggaacaatttgcagaaagagaaacaaagttggattaatctttc

SEQ ID NO: 112 - protein, 278 aa, Arabidopsis thaliana
MGTLGRAIYTVGNWIRGTGQALDRVGSLLQGSHRIEEHLSRHRTLMNVFDKSPLVDKDVFVAPSASVIGDVQIGKGSSIWYGCVLRGDVNNISVGSGTNIQDNTLVHVAKTNISGKVLPTLIGDNVTVGHSAVIHGCTVEDDAFVGMGATLLDGVVVEKHAMVAAGSLVKQNTRIPSGEVWGGNPAKFMRKLTDEEIVYISQSAKNYINLAQIHASENSKSFEQIEVERALRKKYARKDEDYDSMLGITRETPPELILPDNVLPGGKPVAKVPSTQYF

SEQ ID NO: 113 - DNA, 1230 bp, Arabidopsis thaliana
  CDS (109)..(918)
caaagactgcactctctcctcttcctctggctccggcgaaaaaccccttttcgatttcattgataaaacgcaaatcgatctctcgtgtggaagaagaagaagaacacgatgggaacaatgggtaaagcattctacagcgtaggattctggatccgtgaaactggtcaagcacttgatcggctcggttgtcgcctccaagggaaaaatcatttccgagaacagctatcaaggcaccgcacactcatgaatgtttttgacaaaacccctaatgtggataagggggcttttgtggctcctaacgcttctctctctggtgatgtccatgtgggaagaggttcttccatttggtatggatgtgtcttgagagacataccctttgatttaatgaccgactctgcaggagatgctaacagcattagtgttggagctgggaccaatattcaggacaacgctcttgtccacgttgctaagaccaacttaagtgggaaggtcttacctactgtcattggagacaatgtcaccattggtcatagtgctgttttacatggctgcactgtcgaggatgaggcctatattggtacaagtgcaactgtcttggatggagctcatgttgaaaaacatgccatggttgcttcaggagctcttgttaggcagaacactagaattccctctggcgaggtttggggaggcaacccagctaaatttctgaggaaggtgacagaagaagaaagagtcttcttctccagttcggctgtggagtactccaacttagctcaagctcacgccacagagaacgcaaagaacttggacgaggctgagttcaagaagcttctaaacaagaagaacgctcgcgatacagaatatgattcagtactcgatgatctcacgctccctgagaatgtaccaaaagcagcttgaggcgtttaacctgtgccgccttgcgaatcttgatttgtttggatttgaaaagtaaaaacaaagaacttgatttcctgcttctccaataaagttttcttgggcgtaaaatccattggccagtgctcactgggaaagttttcggcttaaaggcattcatttctctgttaaagattgtgaggggttttgttctcttgtaacttgagaaagaaaagttgtaaccttttcttcctttttatgtcgtctaataaattgttgatcagacagacatttaggttgacctttgcccataaaaagatagctctgcttcaataa

SEQ ID NO: 114 - protein, 269 aa, Arabidopsis thaliana
MGTMGKAFYSVGFWIRETGQALDRLGCRLQGKNHFREQLSRHRTLMNVFDKTPNVDKGAFVAPNASLSGDVHVGRGSSIWYGCVLRDIPFDLMTDSAGDANSISVGAGTNIQDNALVHVAKTNLSGKVLPTVIGDNVTIGHSAVLHGCTVEDEAYIGTSATVLDGAHVEKHAMVASGALVRQNTRIPSGEVWGGNPAKFLRKVTEEERVFFSSSAVEYSNLAQAHATENAKNLDEAEFKKLLNKKNARDTEYDSVLDDLTLPENVPKAA

SEQ ID NO: 115 - DNA, 1042 bp, Arabidopsis thaliana
  CDS (55)..(816)
actctctctcttttcctctttgcaaatccttgaagaaatccaaaatccatagcaatggcgacttcgatagctcgattgtctcggagaggagtcacttctaacctgatccgtcgttgcttcgctgcggaagcggcgttggcgaggaagacagagttacctaaaccgcaattcacggtgtcgccgtcgacggatcgtgtgaaatgggactacagaggccaacgacagatcattcctttgggacagtggcttccgaaggtagccgttgatgcttacgtggcacccaacgttgtgctggctggtcaggtcacagtctgggacggctcgtctgtttggaacggtgccgttttgcgcggcgatctcaacaaaatcactgttggattctgctcgaatgtacaggaacggtgtgttgttcatgccgcctggtcttccccaacaggattaccagcagcgacaataatcgacaggtatgtgacagtaggtgcctacagtcttctgagatcatgtaccatcgaaccagagtgcatcatcggtcaacactcaatactaatggaaggctcactggttgagacccggtcaatcttggaagcgggttcagttgtgccgccaggaagaaggatcccatcaggtgaactatggggaggcaatccagcaagattcattagaaccctaaccaacgaagaaaccctagagatcccaaaactcgctgtagccatcaaccacttaagcggagattacttctctgagttcctaccttactcaactgtctacttagaggtagagaagttcaagaagtcccttgggatcgccgtttagaagcttcatctttttcgtgattcactttcatgtgtttatctatcatatgaggtctttctctctgcatattgcaataagtagctgatgaacatcaaaacaagtccggctctcttttttggttctaaaacgtttgtcatttcgttttttgggttctttgtaaaattccatttaaaactgattttggctgaatattgtctgaatgataatggcgacgacttctggttttgtt

SEQ ID NO: 116 - protein, 252 aa, Arabidopsis thaliana
MATSIARLSRRGVTSNLIRRCFAAEAALARKTELPKPQFTVSPSTDRVKWDYRGQRQIIPLGQWLPKVAVDAYVAPNVVLAGQVTVWDGSSVWNGAVLRGDLNKITVGFCSNVQERCVVHAAWSSPTGLPAATIIDRYVTVGAYSLLRSCTIEPECIIGQHSILMEGSLVETRSILEAGSVVPPGRRIPSGELWGGNPARFIRTLTNEETLEIPKLAVAINHLSGDYFSEFLPYSTVYLEVEKFKKSLGIAV

SEQ ID NO: 117 - DNA, 1130 bp, Arabidopsis thaliana
  CDS (97)..(870)
ctcccgacgactcctctctgtctcctcctccgggaagctttctgtctctctctctctctctctacacaagaccttgaagaatccgattccataacaatggcgacttcgttagcacgaatctctaaaagaagcataacatcggctgtttcatcgaatctgattcggcgttacttcgccgcggaagcagtagcggtggcgacgacggaaacacctaaaccgaaatcgcaggtgacgccgtcgccggatcgggtaaaatgggactacagaggccagagacagataattcctctgggacagtggctaccgaaggtagctgtagatgcttacgtggcacctaacgttgtgttggctggtcaggtcaccgtctgggacggctcgtctgtatggaacggtgccgttttgagaggagatcttaataagatcaccgttggattctgctcaaatgtccaggaacggtgtgttgttcatgctgcgtggtcgtcgcctacaggattaccagcacaaacattgatcgataggtacgtgacagttggtgcatacagtcttttaagatcatgcactatcgaaccagaatgcatcatcgggcaacactcaatcctaatggaaggttcactggtcgaaacccgctcaatcctagaagctggttctgttttaccacctggcagaagaatcccatctggtgaactatggggaggcaatccagcaaggtttattcgaacactcaccaatgaagaaaccttagagatcccgaaacttgctgttgccattaaccacctaagtggagattacttctcagagttcttgccttactcaactatctatctagaggttgagaagttcaagaaatcccttggaatcgccatctagaaagcttcttccaggtttctggctacttccctcattaagaaagcttcttcgttttcggaatttgatctgaataagtagctgcggaacaagaaaaagagcagagctgtgtttcaaatgttgtcttctctgtttgttttgtttaagttcatatccttgtgttcaaactttctatgaagatgataatggtgaaaactggaaagtgtaaaacttctttcgtctcccctcacaattggaaaagctaataatctcgtagtgttatagaa

SEQ ID NO: 118 - protein, 256 aa, Arabidopsis thaliana
MATSLARISKRSITSAVSSNLIRRYFAAEAVAVATTETPKPKSQVTPSPDRVKWDYRGQRQIIPLGQWLPKVAVDAYVAPNVVLAGQVTVWDGSSVWNGAVLRGDLNKITVGFCSNVQERCVVHAAWSSPTGLPAQTLIDRYVTVGAYSLLRSCTIEPECIIGQHSILMEGSLVETRSILEAGSVLPPGRRIPSGELWGGNPARFIRTLTNEETLEIPKLAVAINHLSGDYFSEFLPYSTIYLEVEKFKKSLGIAI

SEQ ID NO: 119 - protein, 30 aa, Artificial Sequence
  STOMAGEN amino acid sequence
LLPQVHLLNSRRRHMIGSTAPTCTYNECRG

SEQ ID NO: 120 - protein, 75 aa, Artificial Sequence
  amino acid sequence of EPF2-Long
HKKEISKNGGVEMEMYPTGSSLPDCSYACGACSPCKRVMISFECSVAESCSVIYRCTCRGRYYHVPSRAHHHHHH

SEQ ID NO: 121 - protein, 30 aa, Artificial Sequence
  amino acid sequence of EPF1
KRQRRRPDTVQVAGSRLPDCSHACGSCSPC

SEQ ID NO: 122 - protein, 30 aa, Artificial Sequence
  amino acid sequence of EPF2
SKNGGVEMEMYPTGSSLPDCSYACGACSPC

SEQ ID NO: 123 - DNA, 20 bp, artificial sequence
  synthetic oligonucleotide
cgccgcgtgttctttggtcg

SEQ ID NO: 124 - DNA, 23 bp, artificial sequence
  synthetic oligonucleotide
cggcgtttttcttttctccgcca

SEQ ID NO: 125 - DNA, 17 bp, artificial sequence
  synthetic oligonucleotide
atacgcgctgagttccc

SEQ ID NO: 126 - DNA, 16 bp, artificial sequence
  synthetic oligonucleotide
ctgactggccctgctt

SEQ ID NO: 127 - DNA, 23 bp, artificial sequence
  synthetic oligonucleotide
atggcagctcctcatgtttcagc

SEQ ID NO: 128 - DNA, 24 bp, artificial sequence
  synthetic oligonucleotide
cgttgtttgtttgagtcgctgttg

SEQ ID NO: 129 - protein, 19 aa, artificial sequence
  synthetic peptide
SKNGGVEMEMYPTGSSLPD

SEQ ID NO: 130 - protein, 17 aa, artificial sequence
  synthetic peptide
SKNGGVEMEMYPTGSSL

SEQ ID NO: 131 - protein, 15 aa, artificial sequence
  synthetic peptide
SKNGGVEMEMYPTGS

SEQ ID NO: 132 - protein, 15 aa, artificial sequence
  synthetic peptide
TTHSWDFLKYQTSVK

What is claimed is:

1. A method for:
   increasing the number of stomatal cores corn oared to the total number of cells, or increasing the stomatal density, stomatal index and/or stomatal size, in a plant, plant part, a plant organ, a plant leaf;
   up-regulating or increasing carbon dioxide (CO2) and/or water exchange in a guard cell, a root cell, a stomatal lineage stage-specific cell, a plant leaf, a plant organ, a plant part or a plant;
   decreasing the water use efficiency of a guard cell, a root cell, a stomatal lineage stage-specific cell, a plant leaf, a plant organ, a plant part or a plant;
   decreasing or desensitizing the carbon dioxide (CO2) sensitivity of a guard cell, a root cell, a stomatal lineage stage-specific cell, a plant leaf, a plant organ, a plant part or a plant;
   upregulating or increasing carbon dioxide (CO2) and/or water exchange in a guard cell, a root cell, a stomatal lineage stage-specific rev, a plant leaf, a plant organ, a plant part or a plant;
   increasing the uptake of CO2 in a guard cell, a root cell, a stomatal lineage stage-specific cell, a plant leaf, a plant organ, a plant part or a plant;
   decreasing drought tolerance in a guard cell, a root cell, a stomatal lineage stage-specific cell, a plant leaf, a plant organ, a plant part or a plant; or
   increasing the heat resistance or tolerance, optionally increasing the heat resistance or tolerance, under conditions of drought or increased atmospheric carbon dioxide;
   comprising:
   decreasing the expression and/or activity of:
      (1) a nucleic acid encoding an ATSBT5.2-like protein; or
      (2) an ATSBT5.2-like protein;
   wherein the ATSBT5.2-like protein comprises:
      a) the amino acid sequence as set forth in SEQ ID NO: 5, and
      wherein the decreasing of expression and/or activity of the ATSBT5.2-like protein, is by:
         introducing to a guard cell, root cell, stomatal lineage stage-specific cell, plant leaf, plant organ, plant part or plant a nucleic acid encoding a heterologous antisense nucleotide, interfering RNA, or microRNA that targets the ATSBT5.2-like protein-encoding nucleic acid sequence; and,
      expressing the heterologous antisense nucleotide, interfering RNA, or microRNA, in the guard cell, root cell, stomatal lineage stage-specific cell, plant leaf, plant organ, plant part or plant,
      or introducing to a guard cell, root cell, stomatal lineage stage-specific cell, plant leaf, plant organ, plant part or plant a heterologous antisense nucleotide, interfering RNA or microRNA that targets the ATSBT5.2-like protein-encoding nucleic acid sequence
   wherein the heterologous antisense nucleotide, interfering RNA or microRNA comprises a nucleotide sequence having at least about 11, 12, 13, 14, 15, 16, 17, 18, or 19 or more consecutive nucleotides of a nucleotide sequence encoding the sequence of SEQ ID NO:5, or the complement thereof;
   thereby:
   increasing the number of stomatal pores compared to the total number of cells, or increasing the stomatal density, stomatal index and/or stomatal size, in a plant, plant part, a plant organ, a plant leaf;
   up-regulating or increasing carbon dioxide (002) and/or water exchange in a guard cell, a root cell, a stomatal lineage stage-specific cell, a plant leaf, a plant organ, a plant part or a plant;
   decreasing the water use efficiency of a guard cell, a root cell, a stomatal lineage stage-specific cell, a plant leaf, a plant organ, a plant part or a plant;
   decreasing or desensitizing the carbon dioxide (CO2) sensitivity of a guard cell, a root cell, a stomatal lineage stage-specific cell, a plant leaf, a plant organ, a plant part or a plant;
   upregulating or increasing carbon dioxide (CO2) and/or water exchange in a guard cell, a root cell, a stomatal lineage stage-specific cell, a plant leaf, a plant organ, a plant part or a plant;
   increasing the uptake of CO2 in a guard cell, a root cell, a stomatal lineage stage-specific cell, a plant leaf, a plant organ, a plant part or a plant;
   decreasing drought tolerance in a guard cell, a root cell, a stomatal lineage stage-specific cell, a plant leaf, a plant organ, a plant part or a plant; or
   increasing the heat resistance or tolerance, optionally increasing the heat resistance or tolerance under conditions of drought or increased atmospheric carbon dioxide.

2. The method of claim 1, wherein the ATSBT5.2-like protein-expressing nucleic acid is operably linked to a plant expressible promoter, an inducible promoter, a constitutive promoter, a root specific promoter, a stomatal lineage stage-specific cell specific promoter, a guard cell specific promoter, a drought-inducible promoter, a stress-inducible promoter or a guard cell active promoter.

3. The method of claim 1, wherein the plant is, or the guard cell, plant cell, plant part or plant organ, is isolated and/or derived from:
   (i) a dicotyledonous or monocotyledonous plant;
   (ii) wheat, oat, rye, barley, rice, sorghum, maize or corn, tobacco, a legume, a lupins, potato, sugar beet, pea, bean, soybean or soy, a cruciferous plant, a cauliflower, rape (or *rapa* or canola), cane (sugarcane), flax, cotton, palm, sugar beet, peanut, a tree, a poplar, a lupin, a silk cotton tree, desert willow, creosote bush, winterfat, balsa, ramie, kenaf, hemp, roselle, jute, or sisal abaca; or,
   (iii) a species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus*, Man[iota]hot, *Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna* or *Zea*.

4. The method of claim 1, wherein the ATSBT5.2-like protein-expressing nucleic acid is a gene, a cDNA or an mRNA.

\* \* \* \* \*